US007494979B2

(12) United States Patent
Currie et al.

(10) Patent No.: US 7,494,979 B2
(45) Date of Patent: Feb. 24, 2009

(54) METHOD FOR TREATING CONGESTIVE HEART FAILURE AND OTHER DISORDERS

(75) Inventors: Mark G. Currie, Sterling, MA (US); Shalina Mahajan-Miklos, Palo Alto, CA (US); Li Jing Sun, New York, NY (US); Caroline Kurtz, Sudbury, MA (US)

(73) Assignee: Ironwood Pharmaceuticals, Inc., Cambridge, MA (US)

( * ) Notice: Subject to any disclaimer, the term of this patent is extended or adjusted under 35 U.S.C. 154(b) by 32 days.

(21) Appl. No.: 11/054,072

(22) Filed: Feb. 8, 2005

(65) Prior Publication Data

US 2006/0094658 A1  May 4, 2006

Related U.S. Application Data

(63) Continuation-in-part of application No. 10/868,744, filed on Jun. 14, 2004.

(60) Provisional application No. 60/571,386, filed on May 14, 2004, provisional application No. 60/532,361, filed on Dec. 23, 2003, provisional application No. 60/478,492, filed on Jun. 13, 2003.

(51) Int. Cl.
*A61K 38/16* (2006.01)
*C07K 7/08* (2006.01)
(52) U.S. Cl. ............................ 514/13; 514/14; 530/326; 530/327
(58) Field of Classification Search ........................ None
See application file for complete search history.

(56) References Cited

U.S. PATENT DOCUMENTS

| | | | | |
|---|---|---|---|---|
| 5,140,102 | A | 8/1992 | Currie | 530/326 |
| 5,395,490 | A | 3/1995 | Hoff et al. | 204/132 |
| 5,489,670 | A | 2/1996 | Currie et al. | 530/326 |
| 5,879,656 | A | 3/1999 | Waldman | 424/149 |
| 5,962,220 | A | 10/1999 | Waldman | 435/6 |
| 5,969,097 | A | 10/1999 | Wiegand et al. | 530/326 |
| 6,060,037 | A | 5/2000 | Waldman | 424/1.65 |
| 6,586,403 | B1 * | 7/2003 | Mathison et al. | 514/18 |
| 2003/0073628 | A1 | 4/2003 | Shailubhai et al. | 514/12 |
| 2003/0232013 | A1 | 12/2003 | Siechman et al. | 424/1.69 |
| 2004/0121961 | A1 | 6/2004 | Masferrer | 514/15 |
| 2004/0152868 | A1 | 8/2004 | Larsen et al. | 530/317 |
| 2004/0258687 | A1 | 12/2004 | Waldman et al. | 424/143.1 |
| 2004/0266989 | A1 | 12/2004 | Currie et al. | 530/326 |
| 2005/0032684 | A1 | 2/2005 | Cetin et al. | 514/12 |
| 2006/0094658 | A1 * | 5/2006 | Currie et al. | 514/13 |

FOREIGN PATENT DOCUMENTS

| | | |
|---|---|---|
| EP | 1012188 | 6/2000 |
| WO | WO 99/14239 | 3/1999 |
| WO | WO 01/25266 | 4/2001 |
| WO | WO 02/062369 | 8/2002 |
| WO | WO 02/078683 | 10/2002 |
| WO | WO 02/079235 | 10/2002 |
| WO | WO 02/098912 | 12/2002 |
| WO | WO 03/072125 | 9/2003 |
| WO | WO 2004/071436 | 8/2004 |
| WO | WO2006/001931 | 1/2006 |

OTHER PUBLICATIONS

ExPASy PeptideCutter. internet document <<http://ca.expasy.org/tools/peptidecutter/peptidecutter_enzymes/html>>. Last updated Mar. 26, 2007, accessed Jun. 13, 2007; 12 pages.*
J. Rudinger. In: Peptide Hormones, JA Parsons, Ed. (1976) 1-7.*
D. Voet and J.G. Voet. Biochemistry, 2nd Edition.(1995), pp. 235-241.*
W.S. Messer, "Vasopressin and Oxytocin", web document updated Apr. 3, 2000; <http://www.neurosci.pharm.utoledo.edu/MBC3320/vasopressin.htm>; 5 pages.*
S. Yuge et al. J. Biol. Chem. (2003) 278(25), pp. 22726-22733.*
Amarante et al., "The k-opioid agonist (±)-bremazocine elicits peripheral antinociception by activation of the L-arginine/nitric oxide/cyclic GMP pathway" *European Journal of Pharmacology*, vol. 454: pp. 19-23 (2002).
Arita et al., "Purification and characterization of a heat-stable enterotoxin of *Vibrio mimicus*" *FEMS Microbiology Letters*, vol. 79/1: pp. 105-110 (1991).
Chan et al., "Amino Acid Sequence of Heat-stable Enterotoxin Produced by *Escherichia coli* Pathogenic for Man" *The Journal of Biological Chemistry*, vol. 256, No. 15: pp. 7744-7746 (1981).
Forte et al., "Lymphoguanylin: Cloning and Characterization of a Unique Member of the Guanylin Peptide Family" *Endocrinology*, vol. 140, No. 4: pp. 1800-1806 (1999).
Giannela, "*Escherichia coli* heat-stable enterotoxins, guanylins, and their receptors: What are they and what do they do?" *The Journal of Laboratory and Clinical Medicine*, vol. 125, No. 2: pp. 173-181 (1995).
Gualillo et al., "Ghrelin, a widespread hormone: insights into molecular and cellular regulation of its expression and mechanism of action" *FEBS Letters*, vol. 552: pp. 105-109 (2003).

(Continued)

*Primary Examiner*—Andrew D Kosar
(74) *Attorney, Agent, or Firm*—Fish & Richardson P.C.

(57) ABSTRACT

Compositions and related methods for treating IBS and other gastrointestinal disorders and conditions (e.g., gastrointestinal motility disorders, functional gastrointestinal disorders, gastroesophageal reflux disease (GERD), duodenogastric reflux, Crohn's disease, ulcerative colitis, inflammatory bowel disease, functional heartburn, dyspepsia (including functional dyspepsia or nonulcer dyspepsia), gastroparesis, chronic intestinal pseudo-obstruction (or colonic pseudoobstruction), and disorders and conditions associated with constipation, e.g., constipation associated with use of opiate pain killers, post-surgical constipation, and constipation associated with neuropathic disorders as well as other conditions and disorders are described. The compositions feature peptides that activate the guanylate cyclase C (GC-C) receptor.

14 Claims, 221 Drawing Sheets

OTHER PUBLICATIONS

Guarino et al., "Citrobacter freundii Produces an 18-Amino-Acid Heat-Stable Enterotoxin Identical to the 18-Amino-Acid *Escherichia coli* Heat-Stable Enterotoxin (ST Ia)" *Infection and Immunity*, vol. 57, No. 2: pp. 649-652 (1989).

Huang et al., "Nucleotide sequence of a gene encoding the novel *Yersinia enterocolitica* heat-stable enterotoxin that includes a pro-region-like sequence in its mature toxin molecule" *Microbial Pathogenesis*, vol. 22: pp. 89-97 (1997).

Jain et al., "Sildenafil-induced peripheral analgesia and activation of the nitric oxide-cyclic GMP pathway" *Brain Research*, vol. 909: pp. 170-178 (2001).

Kim et al., "Changes in ghrelin and ghrelin receptor expression according to feeding status" *NeuroReport*, vol. 14, No. 10: pp. 1317-1320 (2003).

Lazaro-Ibanez et al., "Participation of the nitric oxide-cyclic GMP-ATP-sensitive $K^+$ channel pathway in the antinociceptive action of ketorolac" *European Journal of Pharmacology*, vol. 426: pp. 39-44 (2001).

Moseley et al., "Isolation and Nucleotide Sequence Determination of a Gene Encoding a Heat-Stable Enterotoxin of *Escherichia coli*" *Infection and Immunity*, vol. 39, No. 3: pp. 1167-1174 (1983).

Nzegwu et al., "Luminal capsaicin inhibits fluid secretion induced by exterotoxin *E. coli* STa, but not by carbachol, in vivo in rat small and large intestines" *Experimental Physiology*, vol. 81, No. 2: pp. 313-315 (1996).

Rolfe et al., "Enterotoxin *Escherichia coli* STa activates a nitric oxide-dependent myenteric plexus secretory reflex in the rat ileum" *The Journal of Physiology*, vol. 475, No. 3: pp. 531-537 (1994).

Rolfe et al., "Vagotomy inhibits the jejunal fluid secretion activated by luminal ileal *Escherichia coli* STa in the rat in vivo" *Gut*, vol. 44: pp. 615-619 (1999).

Shailubhai, "Therapeutic applications of guanylate cyclase-C receptor agonists" *Drug Discovery & Development*, vol. 5 No. 2: pp. 261-268 (2002).

So et al., "Nucleotide Sequence of the Bacterial Transposon Tn1681 Encoding a Heat-Stable (ST) Toxin and Its Identification of Enterotoxigenic *Escherichia coli* Strains" *Proceedings of the National Academy of Sciences of the U.S.A..*, vol. 77, No. 7 [Part 2: Biological Sciences]: pp. 4011-4015 (1980).

Soares, et al., "Dibutyryl-cyclic GMP induces peripheral antinociception via activation of ATP-sensitive $K^+$ channels in the Rat $PGE_2$-induced hyperalgesic paw" *British Journal of Pharmacology*, vol. 134: pp. 127-131 (2001).

Takao et al., "Amino acid sequence of heat-stable enterotoxin produced by *Vibrio cholerae* non-O1" *FEBS*), vol. 193, No. 2: pp. 250-254 (1985).

Takao et al., "Isolation, primary structure and synthesis of heat-stable enterotoxin produced by *Yersinia enterocolitica*" *European Journal of Biochemistry*, vol. 152, No. 1: pp. 199-206 (1985).

Vaandrager et al., "Structure and function of the heat-stable enterotoxin receptor/guanylyl cyclase C" *Molecular and Cellular Biochemistry*, vol. 230, Nos. 1&2: pp. 73-83 (2002).

GenBank Accession No. QHECIB; GI:69638; Aimoto et al., Jun. 18, 1999.
GenBank Accession No. P01559; GI:123711; So et al., Oct. 25, 2004.
GenBank Accession No. AAA24653; GI:147878; Sekizaki et al., Apr. 26, 1993.
GenBank Accession No. P01560; GI:123707; Chan et al., Jun. 15, 2004.
GenBank Accession No. AAA27561; GI:295439; Ogawa et al., Jun. 12, 1993.
GenBank Accession No. P04429; GI:123712; Ogawa et al., Jun. 15, 2004.
GenBank Accession No. S34671; GI:421286; Rossolini et al., Apr. 12, 1995.
GenBank Accession No. CAA52209; GI:395161; Guglielmetti et al;, Jul. 27, 1995.
GenBank Accession No. A54534; GI:628844; Arita et al., May 3, 1996.
GenBank Accession No. AAL02159; GI:15592919; Teixeira et al., Sep. 13, 2001.
GenBank Accession No. AAA18472; GI:487395; Mikulskis et al., May 26, 1994.
GenBank Accession No. S25659; GI:282047; Takao et al., Oct. 15, 1999.
GenBank Accession No. P74977; GI:3913874; Ramamurthy et al., Jun. 15, 2004.
GenBank Accession No. BAA23656; GI:2662339; Huang et al., Feb. 13, 1999.
GenBank Accession No. P31518; GI:399947; Ibrahim et al., Mar. 15, 2004.
GenBank Accession No. P07965; GI:3915589; Stieglitz et al., Jun. 15, 2004.

Schulz et al., "Side chain contributions to the interconversion of the topological isomers of guanylin-like peptides" *J. Pept. Sci.* 11(6):319-30, 2005.

Camilleri, "Management of the Irritable Bowel Syndrome" *Gastroenterology* 120:652-668, 2001.

Drossman, D.A., "The functional gastrointestinal disorders and the Rome II process" *Gut* 45:Supp. II:111-113, 1999.

Drossman, D.A., "Psychosocial aspects of the functional gastrointestinal disorders" *Gut* 45:Supp. II:1125-1130, 1999.

Drossman et al., "U.S. Householder Survey of Functional Gastrointestinal Disorders" *Digestive Diseases and Sciences* 38(9):1569-1580, 1993.

Ringel, et al., "Irritable Bowel Syndrome" *Annu. Rev. Med.* 52:319-38, 2001.

Santos-Neto, et al., "Guanylin and its Lysine-Containing Analogue in the Isolated Perfused Rat Kideny" *Pharmacol. & Toxicol.* 92:114-120, 2003.

Talley, et al., "Irritable Bowel Syndrome in a Community: Symptom Subgroups, Risk.." *Am. J. of Epidemiology* 142(1):76-83, 1995.

Talley, et al., "Medical Costs in Community Subjects with Irritable Bowel Syndrome" *Gastroenterology* 109(6):1736-1741, 1995.

Carrithers et al., "Guanylin and Uroguanylin Induce Matriuresis in Mice Lacking Cyclase-C Receptor" *Kideny Int'l.* 65:40-53, 2004.

Carrithers et al., "Renal Effects of Uroguanylin and Guanylin in vivo" *Barzilian J. of Med. And Biol. Res.* 32:1337-1344, 1999.

Elitsur et al., "The Proximal Convoluted Tubule is a Target for the Uroguanylin-regulated Natriuretic Response" *J. of Ped. Gastroent. And Nutric.* 43:S74-S81, 2006.

Fonteles et al., "Natriuretic and Kaliuretic Activities of Guanylin and Uroguanylin in the Isolated Perfused Rat Kidney" *Amer. J. Physiol. Renal Physiol.* 275:191-197, 2998.

Forte et al., "Guanylin Peptides: Renal Actions Mediated by Cyclic GMP" *Am J. Physiol. Renal Physiol.* 278:180-191, 2000.

Forte et al., "Salt and Water Homeostasis: Uroguanylin is a Circulating Peptide Hormone with Natriuretic Activity" *Amer. J. of Kidney Diseases* 28(2):296-304, 1996.

Greenberg et al., "Comparison of Effects of Uroguanylin, Guanylin, and *Escherichia coli* Heat-Stable . . . " *J. of Investig. Med.* 45(5):276-283, 1997.

Kikuchi et al., "Role of Uroguanylin, a Peptide with Natriuretic Activity, in Rats with Experimental Nephrotic Syndrome" *J. Amer. Soc. Nephrol.* 16:392-397, 2005.

Kokot et al., "Guanylins-Are they of Nephrological Relevance?" *Nephron* 84:201-205, 2000.

London et al., "Structure and Activity of OK-GC: a Kidney Receptor Guanylate Cyclase Activated by Guanylin Peptides" *Am. J. Physiol. Renal Physiol.* 276:882-891, 1999.

Lorenz et al., "Uroguanylin Knockout Mice have Increased Blood Pressure and Impaired Natriuretic Response . . . " *J. of Clinical Invest.* 112(8):1244-1254, 2003.

Sindic et al., "Cellular Effects of Guanylin and Uroguanylin" *J. Amer. Soc. Nephrol* 17:607-616, 2006.

Sindic et al. "Guanylin and Uroguanylin Regulate Electrolyte Transport in Isolated Human Cortical Collecting Ducts" *Kidney Inter'l.* 67:1420-1427, 2005.

Sindic et al., "Mechanisms of Actions of Guanylin Peptides in the Kidney" *Eur. J. Physiol.* 450:283-291, 2005.

Wang et al., "Effects of Uroguanylin, an Intestinal Natriuretic Peptide, on Tubuloglomerular Feedback" *Hypertens. Res.* 26(7):577-582, 2003.

* cited by examiner

Pro Gly Thr Cys Gly Glu Ile Cys Ala Tyr Ala Ala Cys Thr Gly Cys

Human Guanylin (SEQ ID NO:19)

| | | | | | | | | | | | | | | | | |
|---|---|---|---|---|---|---|---|---|---|---|---|---|---|---|---|---|
| --- | Gly | Thr | Cys | Gly | Glu | Ile | Cys | Ala | Tyr | Ala | Ala | Cys | Thr | Gly | Cys | (SEQ ID NO: 96) |
| --- | --- | Thr | Cys | Gly | Glu | Ile | Cys | Ala | Tyr | Ala | Ala | Cys | Thr | Gly | Cys | (SEQ ID NO: 97) |
| --- | --- | --- | Cys | Gly | Glu | Ile | Cys | Ala | Tyr | Ala | Ala | Cys | Thr | Gly | Cys | (SEQ ID NO: 98) |
| --- | --- | --- | Cys | --- | Glu | Ile | Cys | Ala | Tyr | Ala | Ala | Cys | Thr | Gly | Cys | (SEQ ID NO: 99) |
| --- | --- | --- | Cys | Gly | --- | Ile | Cys | Ala | Tyr | Ala | Ala | Cys | Thr | Gly | Cys | (SEQ ID NO: 100) |
| --- | --- | --- | Cys | Gly | Glu | --- | Cys | Ala | Tyr | Ala | Ala | Cys | Thr | Gly | Cys | (SEQ ID NO: 101) |
| --- | --- | --- | Cys | Gly | Glu | Ile | Cys | --- | Tyr | Ala | Ala | Cys | Thr | Gly | Cys | (SEQ ID NO: 102) |
| --- | --- | --- | Cys | Gly | Glu | Ile | Cys | Ala | --- | Ala | Ala | Cys | Thr | Gly | Cys | (SEQ ID NO: 103) |
| --- | --- | --- | Cys | Gly | Glu | Ile | Cys | Ala | Tyr | --- | Ala | Cys | Thr | Gly | Cys | (SEQ ID NO: 104) |
| --- | --- | --- | Cys | Gly | Glu | Ile | Cys | Ala | Tyr | Ala | --- | Cys | Thr | Gly | Cys | (SEQ ID NO: 105) |
| --- | --- | --- | Cys | Gly | Glu | Ile | Cys | Ala | Tyr | Ala | Ala | Cys | --- | Gly | Cys | (SEQ ID NO: 106) |
| --- | --- | --- | Cys | Gly | Glu | Ile | Cys | Ala | Tyr | Ala | Ala | Cys | Thr | --- | Cys | (SEQ ID NO: 107) |
| --- | --- | Thr | Cys | --- | Glu | Ile | Cys | Ala | Tyr | Ala | Ala | Cys | Thr | Gly | Cys | (SEQ ID NO: 108) |
| --- | --- | Thr | Cys | --- | --- | Ile | Cys | Ala | Tyr | Ala | Ala | Cys | Thr | Gly | Cys | (SEQ ID NO: 109) |
| --- | --- | Thr | Cys | --- | Glu | --- | Cys | Ala | Tyr | Ala | Ala | Cys | Thr | Gly | Cys | (SEQ ID NO: 110) |
| --- | --- | Thr | Cys | --- | Glu | Ile | Cys | --- | Tyr | Ala | Ala | Cys | Thr | Gly | Cys | (SEQ ID NO: 111) |
| --- | --- | Thr | Cys | --- | Glu | Ile | Cys | Ala | --- | Ala | Ala | Cys | Thr | Gly | Cys | (SEQ ID NO: 112) |
| --- | --- | Thr | Cys | --- | Glu | Ile | Cys | Ala | Tyr | --- | Ala | Cys | Thr | Gly | Cys | (SEQ ID NO: 113) |
| --- | --- | Thr | Cys | --- | Glu | Ile | Cys | Ala | Tyr | Ala | --- | Cys | Thr | Gly | Cys | (SEQ ID NO: 114) |
| --- | --- | Thr | Cys | --- | Glu | Ile | Cys | Ala | Tyr | Ala | Ala | Cys | --- | Gly | Cys | (SEQ ID NO: 115) |
| --- | --- | Thr | Cys | --- | Glu | Ile | Cys | Ala | Tyr | Ala | Ala | Cys | Thr | --- | Cys | (SEQ ID NO: 116) |
| --- | --- | Thr | Cys | Gly | --- | Ile | Cys | Ala | Tyr | Ala | Ala | Cys | Thr | Gly | Cys | (SEQ ID NO: 117) |
| --- | --- | Thr | Cys | Gly | --- | --- | Cys | Ala | Tyr | Ala | Ala | Cys | Thr | Gly | Cys | (SEQ ID NO: 118) |
| --- | --- | Thr | Cys | Gly | --- | Ile | Cys | --- | Tyr | Ala | Ala | Cys | Thr | Gly | Cys | (SEQ ID NO: 119) |
| --- | --- | Thr | Cys | Gly | --- | Ile | Cys | Ala | --- | Ala | Ala | Cys | Thr | Gly | Cys | (SEQ ID NO: 120) |
| --- | --- | Thr | Cys | Gly | --- | Ile | Cys | Ala | Tyr | --- | Ala | Cys | Thr | Gly | Cys | (SEQ ID NO: 121) |
| --- | --- | Thr | Cys | Gly | --- | Ile | Cys | Ala | Tyr | Ala | --- | Cys | Thr | Gly | Cys | (SEQ ID NO: 122) |
| --- | --- | Thr | Cys | Gly | --- | Ile | Cys | Ala | Tyr | Ala | Ala | Cys | --- | Gly | Cys | (SEQ ID NO: 123) |
| --- | --- | Thr | Cys | Gly | --- | Ile | Cys | Ala | Tyr | Ala | Ala | Cys | Thr | --- | Cys | (SEQ ID NO: 124) |
| --- | --- | Thr | Cys | Gly | Glu | --- | Cys | Ala | Tyr | Ala | Ala | Cys | Thr | Gly | Cys | (SEQ ID NO: 125) |
| --- | --- | Thr | Cys | Gly | Glu | --- | Cys | --- | Tyr | Ala | Ala | Cys | Thr | Gly | Cys | (SEQ ID NO: 126) |
| --- | --- | Thr | Cys | Gly | Glu | --- | Cys | Ala | --- | Ala | Ala | Cys | Thr | Gly | Cys | (SEQ ID NO: 127) |
| --- | --- | Thr | Cys | Gly | Glu | --- | Cys | Ala | Tyr | --- | Ala | Cys | Thr | Gly | Cys | (SEQ ID NO: 128) |
| --- | --- | Thr | Cys | Gly | Glu | --- | Cys | Ala | Tyr | Ala | --- | Cys | Thr | Gly | Cys | (SEQ ID NO: 129) |
| --- | --- | Thr | Cys | Gly | Glu | --- | Cys | Ala | Tyr | Ala | Ala | Cys | --- | Gly | Cys | (SEQ ID NO: 130) |
| --- | --- | Thr | Cys | Gly | Glu | --- | Cys | Ala | Tyr | Ala | Ala | Cys | Thr | --- | Cys | (SEQ ID NO: 131) |
| --- | --- | Thr | Cys | Gly | Glu | Ile | Cys | --- | Tyr | Ala | Ala | Cys | Thr | Gly | Cys | (SEQ ID NO: 132) |
| --- | --- | Thr | Cys | Gly | Glu | Ile | Cys | --- | --- | Ala | Ala | Cys | Thr | Gly | Cys | (SEQ ID NO: 133) |
| --- | --- | Thr | Cys | Gly | Glu | Ile | Cys | --- | Tyr | --- | Ala | Cys | Thr | Gly | Cys | (SEQ ID NO: 134) |
| --- | --- | Thr | Cys | Gly | Glu | Ile | Cys | --- | Tyr | Ala | --- | Cys | Thr | Gly | Cys | (SEQ ID NO: 135) |
| --- | --- | Thr | Cys | Gly | Glu | Ile | Cys | --- | Tyr | Ala | Ala | Cys | --- | Gly | Cys | (SEQ ID NO: 136) |
| --- | --- | Thr | Cys | Gly | Glu | Ile | Cys | --- | Tyr | Ala | Ala | Cys | Thr | --- | Cys | (SEQ ID NO: 137) |
| --- | --- | Thr | Cys | Gly | Glu | Ile | Cys | Ala | --- | Ala | Ala | Cys | Thr | Gly | Cys | (SEQ ID NO: 138) |
| --- | --- | Thr | Cys | Gly | Glu | Ile | Cys | Ala | --- | --- | Ala | Cys | Thr | Gly | Cys | (SEQ ID NO: 139) |

FIG. 1

| | | | | | | | | | | | | | |
|---|---|---|---|---|---|---|---|---|---|---|---|---|---|
| --- | --- | Thr | Cys | Gly | Glu | Ile | Cys | Ala | --- | Ala | --- | Cys | Thr | Gly | Cys | (SEQ ID NO: 140) |
| --- | --- | Thr | Cys | Gly | Glu | Ile | Cys | Ala | --- | Ala | Ala | Cys | --- | Gly | Cys | (SEQ ID NO: 141) |
| --- | --- | Thr | Cys | Gly | Glu | Ile | Cys | Ala | --- | Ala | Ala | Cys | Thr | --- | Cys | (SEQ ID NO: 142) |
| --- | --- | Thr | Cys | Gly | Glu | Ile | Cys | Ala | Tyr | --- | Ala | Cys | Thr | Gly | Cys | (SEQ ID NO: 143) |
| --- | --- | Thr | Cys | Gly | Glu | Ile | Cys | Ala | Tyr | --- | --- | Cys | Thr | Gly | Cys | (SEQ ID NO: 144) |
| --- | --- | Thr | Cys | Gly | Glu | Ile | Cys | Ala | Tyr | --- | Ala | Cys | --- | Gly | Cys | (SEQ ID NO: 145) |
| --- | --- | Thr | Cys | Gly | Glu | Ile | Cys | Ala | Tyr | --- | Ala | Cys | Thr | --- | Cys | (SEQ ID NO: 146) |
| --- | --- | Thr | Cys | Gly | Glu | Ile | Cys | Ala | Tyr | Ala | --- | Cys | Thr | Gly | Cys | (SEQ ID NO: 147) |
| --- | --- | Thr | Cys | Gly | Glu | Ile | Cys | Ala | Tyr | Ala | --- | Cys | --- | Gly | Cys | (SEQ ID NO: 148) |
| --- | --- | Thr | Cys | Gly | Glu | Ile | Cys | Ala | Tyr | Ala | --- | Cys | Thr | --- | Cys | (SEQ ID NO: 149) |
| --- | --- | Thr | Cys | Gly | Glu | Ile | Cys | Ala | Tyr | Ala | Ala | Cys | --- | Gly | Cys | (SEQ ID NO: 150) |
| --- | --- | Thr | Cys | Gly | Glu | Ile | Cys | Ala | Tyr | Ala | Ala | Cys | --- | --- | Cys | (SEQ ID NO: 151) |
| --- | --- | Thr | Cys | Gly | Glu | Ile | Cys | Ala | Tyr | Ala | Ala | Cys | Thr | --- | Cys | (SEQ ID NO: 152) |
| --- | Gly | --- | Cys | Gly | Glu | Ile | Cys | Ala | Tyr | Ala | Ala | Cys | Thr | Gly | Cys | (SEQ ID NO: 153) |
| --- | Gly | --- | Cys | --- | Glu | Ile | Cys | Ala | Tyr | Ala | Ala | Cys | Thr | Gly | Cys | (SEQ ID NO: 154) |
| --- | Gly | --- | Cys | --- | --- | Ile | Cys | Ala | Tyr | Ala | Ala | Cys | Thr | Gly | Cys | (SEQ ID NO: 155) |
| --- | Gly | --- | Cys | --- | Glu | --- | Cys | Ala | Tyr | Ala | Ala | Cys | Thr | Gly | Cys | (SEQ ID NO: 156) |
| --- | Gly | --- | Cys | --- | Glu | Ile | Cys | --- | Tyr | Ala | Ala | Cys | Thr | Gly | Cys | (SEQ ID NO: 157) |
| --- | Gly | --- | Cys | --- | Glu | Ile | Cys | Ala | --- | Ala | Ala | Cys | Thr | Gly | Cys | (SEQ ID NO: 158) |
| --- | Gly | --- | Cys | --- | Glu | Ile | Cys | Ala | Tyr | --- | Ala | Cys | Thr | Gly | Cys | (SEQ ID NO: 159) |
| --- | Gly | --- | Cys | --- | Glu | Ile | Cys | Ala | Tyr | Ala | --- | Cys | Thr | Gly | Cys | (SEQ ID NO: 160) |
| --- | Gly | --- | Cys | --- | Glu | Ile | Cys | Ala | Tyr | Ala | Ala | Cys | --- | Gly | Cys | (SEQ ID NO: 161) |
| --- | Gly | --- | Cys | --- | Glu | Ile | Cys | Ala | Tyr | Ala | Ala | Cys | Thr | --- | Cys | (SEQ ID NO: 162) |
| --- | Gly | --- | Cys | Gly | --- | Ile | Cys | Ala | Tyr | Ala | Ala | Cys | Thr | Gly | Cys | (SEQ ID NO: 163) |
| --- | Gly | --- | Cys | Gly | --- | --- | Cys | Ala | Tyr | Ala | Ala | Cys | Thr | Gly | Cys | (SEQ ID NO: 164) |
| --- | Gly | --- | Cys | Gly | --- | Ile | Cys | --- | Tyr | Ala | Ala | Cys | Thr | Gly | Cys | (SEQ ID NO: 165) |
| --- | Gly | --- | Cys | Gly | --- | Ile | Cys | Ala | --- | Ala | Ala | Cys | Thr | Gly | Cys | (SEQ ID NO: 166) |
| --- | Gly | --- | Cys | Gly | --- | Ile | Cys | Ala | Tyr | --- | Ala | Cys | Thr | Gly | Cys | (SEQ ID NO: 167) |
| --- | Gly | --- | Cys | Gly | --- | Ile | Cys | Ala | Tyr | Ala | --- | Cys | Thr | Gly | Cys | (SEQ ID NO: 168) |
| --- | Gly | --- | Cys | Gly | --- | Ile | Cys | Ala | Tyr | Ala | Ala | Cys | --- | Gly | Cys | (SEQ ID NO: 169) |
| --- | Gly | --- | Cys | Gly | --- | Ile | Cys | Ala | Tyr | Ala | Ala | Cys | Thr | --- | Cys | (SEQ ID NO: 170) |
| --- | Gly | --- | Cys | Gly | Glu | --- | Cys | Ala | Tyr | Ala | Ala | Cys | Thr | Gly | Cys | (SEQ ID NO: 171) |
| --- | Gly | --- | Cys | Gly | Glu | --- | Cys | --- | Tyr | Ala | Ala | Cys | Thr | Gly | Cys | (SEQ ID NO: 172) |
| --- | Gly | --- | Cys | Gly | Glu | --- | Cys | Ala | --- | Ala | Ala | Cys | Thr | Gly | Cys | (SEQ ID NO: 173) |
| --- | Gly | --- | Cys | Gly | Glu | --- | Cys | Ala | Tyr | --- | Ala | Cys | Thr | Gly | Cys | (SEQ ID NO: 174) |
| --- | Gly | --- | Cys | Gly | Glu | --- | Cys | Ala | Tyr | Ala | --- | Cys | Thr | Gly | Cys | (SEQ ID NO: 175) |
| --- | Gly | --- | Cys | Gly | Glu | --- | Cys | Ala | Tyr | Ala | Ala | Cys | --- | Gly | Cys | (SEQ ID NO: 176) |
| --- | Gly | --- | Cys | Gly | Glu | --- | Cys | Ala | Tyr | Ala | Ala | Cys | Thr | --- | Cys | (SEQ ID NO: 177) |
| --- | Gly | --- | Cys | Gly | Glu | Ile | Cys | --- | Tyr | Ala | Ala | Cys | Thr | Gly | Cys | (SEQ ID NO: 178) |
| --- | Gly | --- | Cys | Gly | Glu | Ile | Cys | --- | --- | Ala | Ala | Cys | Thr | Gly | Cys | (SEQ ID NO: 179) |
| --- | Gly | --- | Cys | Gly | Glu | Ile | Cys | --- | Tyr | --- | Ala | Cys | Thr | Gly | Cys | (SEQ ID NO: 180) |
| --- | Gly | --- | Cys | Gly | Glu | Ile | Cys | --- | Tyr | Ala | --- | Cys | Thr | Gly | Cys | (SEQ ID NO: 181) |
| --- | Gly | --- | Cys | Gly | Glu | Ile | Cys | --- | Tyr | Ala | Ala | Cys | --- | Gly | Cys | (SEQ ID NO: 182) |
| --- | Gly | --- | Cys | Gly | Glu | Ile | Cys | --- | Tyr | Ala | Ala | Cys | Thr | --- | Cys | (SEQ ID NO: 183) |
| --- | Gly | --- | Cys | Gly | Glu | Ile | Cys | Ala | --- | Ala | Ala | Cys | Thr | Gly | Cys | (SEQ ID NO: 184) |
| --- | Gly | --- | Cys | Gly | Glu | Ile | Cys | Ala | --- | --- | Ala | Cys | Thr | Gly | Cys | (SEQ ID NO: 185) |
| --- | Gly | --- | Cys | Gly | Glu | Ile | Cys | Ala | --- | Ala | --- | Cys | Thr | Gly | Cys | (SEQ ID NO: 186) |

FIG. 1

| | | | | | | | | | | | | | |
|---|---|---|---|---|---|---|---|---|---|---|---|---|---|
|---|Gly|---|Cys|Gly|Glu|Ile|Cys|Ala|---|Ala|Ala|Cys|---|Gly|Cys|(SEQ ID NO: 187)|
|---|Gly|---|Cys|Gly|Glu|Ile|Cys|Ala|---|Ala|Ala|Cys|Thr|---|Cys|(SEQ ID NO: 188)|
|---|Gly|---|Cys|Gly|Glu|Ile|Cys|Ala|Tyr|---|Ala|Cys|Thr|Gly|Cys|(SEQ ID NO: 189)|
|---|Gly|---|Cys|Gly|Glu|Ile|Cys|Ala|Tyr|---|---|Cys|Thr|Gly|Cys|(SEQ ID NO: 190)|
|---|Gly|---|Cys|Gly|Glu|Ile|Cys|Ala|Tyr|---|Ala|Cys|---|Gly|Cys|(SEQ ID NO: 191)|
|---|Gly|---|Cys|Gly|Glu|Ile|Cys|Ala|Tyr|---|Ala|Cys|Thr|---|Cys|(SEQ ID NO: 192)|
|---|Gly|---|Cys|Gly|Glu|Ile|Cys|Ala|Tyr|Ala|---|Cys|Thr|Gly|Cys|(SEQ ID NO: 193)|
|---|Gly|---|Cys|Gly|Glu|Ile|Cys|Ala|Tyr|Ala|---|Cys|---|Gly|Cys|(SEQ ID NO: 194)|
|---|Gly|---|Cys|Gly|Glu|Ile|Cys|Ala|Tyr|Ala|---|Cys|Thr|---|Cys|(SEQ ID NO: 195)|
|---|Gly|---|Cys|Gly|Glu|Ile|Cys|Ala|Tyr|Ala|Ala|Cys|---|Gly|Cys|(SEQ ID NO: 196)|
|---|Gly|---|Cys|Gly|Glu|Ile|Cys|Ala|Tyr|Ala|Ala|Cys|---|---|Cys|(SEQ ID NO: 197)|
|---|Gly|---|Cys|Gly|Glu|Ile|Cys|Ala|Tyr|Ala|Ala|Cys|Thr|---|Cys|(SEQ ID NO: 198)|
|---|Gly|Thr|Cys|---|Glu|Ile|Cys|Ala|Tyr|Ala|Ala|Cys|Thr|Gly|Cys|(SEQ ID NO: 199)|
|---|Gly|Thr|Cys|---|---|Ile|Cys|Ala|Tyr|Ala|Ala|Cys|Thr|Gly|Cys|(SEQ ID NO: 200)|
|---|Gly|Thr|Cys|---|---|---|Cys|Ala|Tyr|Ala|Ala|Cys|Thr|Gly|Cys|(SEQ ID NO: 201)|
|---|Gly|Thr|Cys|---|---|Ile|Cys|---|Tyr|Ala|Ala|Cys|Thr|Gly|Cys|(SEQ ID NO: 202)|
|---|Gly|Thr|Cys|---|---|Ile|Cys|Ala|---|Ala|Ala|Cys|Thr|Gly|Cys|(SEQ ID NO: 203)|
|---|Gly|Thr|Cys|---|---|Ile|Cys|Ala|Tyr|---|Ala|Cys|Thr|Gly|Cys|(SEQ ID NO: 204)|
|---|Gly|Thr|Cys|---|---|Ile|Cys|Ala|Tyr|Ala|---|Cys|Thr|Gly|Cys|(SEQ ID NO: 205)|
|---|Gly|Thr|Cys|---|---|Ile|Cys|Ala|Tyr|Ala|Ala|Cys|---|Gly|Cys|(SEQ ID NO: 206)|
|---|Gly|Thr|Cys|---|---|Ile|Cys|Ala|Tyr|Ala|Ala|Cys|Thr|---|Cys|(SEQ ID NO: 207)|
|---|Gly|Thr|Cys|---|Glu|---|Cys|Ala|Tyr|Ala|Ala|Cys|Thr|Gly|Cys|(SEQ ID NO: 208)|
|---|Gly|Thr|Cys|---|Glu|---|Cys|---|Tyr|Ala|Ala|Cys|Thr|Gly|Cys|(SEQ ID NO: 209)|
|---|Gly|Thr|Cys|---|Glu|---|Cys|Ala|---|Ala|Ala|Cys|Thr|Gly|Cys|(SEQ ID NO: 210)|
|---|Gly|Thr|Cys|---|Glu|---|Cys|Ala|Tyr|---|Ala|Cys|Thr|Gly|Cys|(SEQ ID NO: 211)|
|---|Gly|Thr|Cys|---|Glu|---|Cys|Ala|Tyr|Ala|---|Cys|Thr|Gly|Cys|(SEQ ID NO: 212)|
|---|Gly|Thr|Cys|---|Glu|---|Cys|Ala|Tyr|Ala|Ala|Cys|---|Gly|Cys|(SEQ ID NO: 213)|
|---|Gly|Thr|Cys|---|Glu|---|Cys|Ala|Tyr|Ala|Ala|Cys|Thr|---|Cys|(SEQ ID NO: 214)|
|---|Gly|Thr|Cys|---|Glu|Ile|Cys|---|Tyr|Ala|Ala|Cys|Thr|Gly|Cys|(SEQ ID NO: 215)|
|---|Gly|Thr|Cys|---|Glu|Ile|Cys|---|---|Ala|Ala|Cys|Thr|Gly|Cys|(SEQ ID NO: 216)|
|---|Gly|Thr|Cys|---|Glu|Ile|Cys|---|Tyr|---|Ala|Cys|Thr|Gly|Cys|(SEQ ID NO: 217)|
|---|Gly|Thr|Cys|---|Glu|Ile|Cys|---|Tyr|Ala|---|Cys|Thr|Gly|Cys|(SEQ ID NO: 218)|
|---|Gly|Thr|Cys|---|Glu|Ile|Cys|---|Tyr|Ala|Ala|Cys|---|Gly|Cys|(SEQ ID NO: 219)|
|---|Gly|Thr|Cys|---|Glu|Ile|Cys|---|Tyr|Ala|Ala|Cys|Thr|---|Cys|(SEQ ID NO: 220)|
|---|Gly|Thr|Cys|---|Glu|Ile|Cys|Ala|---|Ala|Ala|Cys|Thr|Gly|Cys|(SEQ ID NO: 221)|
|---|Gly|Thr|Cys|---|Glu|Ile|Cys|Ala|---|---|Ala|Cys|Thr|Gly|Cys|(SEQ ID NO: 222)|
|---|Gly|Thr|Cys|---|Glu|Ile|Cys|Ala|---|Ala|---|Cys|Thr|Gly|Cys|(SEQ ID NO: 223)|
|---|Gly|Thr|Cys|---|Glu|Ile|Cys|Ala|---|Ala|Ala|Cys|---|Gly|Cys|(SEQ ID NO: 224)|
|---|Gly|Thr|Cys|---|Glu|Ile|Cys|Ala|---|Ala|Ala|Cys|Thr|---|Cys|(SEQ ID NO: 225)|
|---|Gly|Thr|Cys|---|Glu|Ile|Cys|Ala|Tyr|---|Ala|Cys|Thr|Gly|Cys|(SEQ ID NO: 226)|
|---|Gly|Thr|Cys|---|Glu|Ile|Cys|Ala|Tyr|---|---|Cys|Thr|Gly|Cys|(SEQ ID NO: 227)|
|---|Gly|Thr|Cys|---|Glu|Ile|Cys|Ala|Tyr|---|Ala|Cys|---|Gly|Cys|(SEQ ID NO: 228)|
|---|Gly|Thr|Cys|---|Glu|Ile|Cys|Ala|Tyr|---|Ala|Cys|Thr|---|Cys|(SEQ ID NO: 229)|
|---|Gly|Thr|Cys|---|Glu|Ile|Cys|Ala|Tyr|Ala|---|Cys|Thr|Gly|Cys|(SEQ ID NO: 230)|
|---|Gly|Thr|Cys|---|Glu|Ile|Cys|Ala|Tyr|Ala|---|Cys|---|Gly|Cys|(SEQ ID NO: 231)|
|---|Gly|Thr|Cys|---|Glu|Ile|Cys|Ala|Tyr|Ala|---|Cys|Thr|---|Cys|(SEQ ID NO: 232)|
|---|Gly|Thr|Cys|---|Glu|Ile|Cys|Ala|Tyr|Ala|Ala|Cys|---|Gly|Cys|(SEQ ID NO: 233)|

FIG. 1

```
--- Gly Thr Cys --- Glu Ile Cys Ala Tyr Ala Ala Cys --- --- Cys   (SEQ ID NO: 234)
--- Gly Thr Cys --- Glu Ile Cys Ala Tyr Ala Ala Cys Thr --- Cys   (SEQ ID NO: 235)
--- Gly Thr Cys Gly --- Ile Cys Ala Tyr Ala Ala Cys Thr Gly Cys   (SEQ ID NO: 236)
--- Gly Thr Cys Gly --- --- Cys Ala Tyr Ala Ala Cys Thr Gly Cys   (SEQ ID NO: 237)
--- Gly Thr Cys Gly --- --- Cys --- Tyr Ala Ala Cys Thr Gly Cys   (SEQ ID NO: 238)
--- Gly Thr Cys Gly --- --- Cys Ala --- Ala Ala Cys Thr Gly Cys   (SEQ ID NO: 239)
--- Gly Thr Cys Gly --- --- Cys Ala Tyr --- Ala Cys Thr Gly Cys   (SEQ ID NO: 240)
--- Gly Thr Cys Gly --- --- Cys Ala Tyr Ala --- Cys Thr Gly Cys   (SEQ ID NO: 241)
--- Gly Thr Cys Gly --- --- Cys Ala Tyr Ala Ala Cys --- Gly Cys   (SEQ ID NO: 242)
--- Gly Thr Cys Gly --- --- Cys Ala Tyr Ala Ala Cys Thr --- Cys   (SEQ ID NO: 243)
--- Gly Thr Cys Gly --- Ile Cys --- Tyr Ala Ala Cys Thr Gly Cys   (SEQ ID NO: 244)
--- Gly Thr Cys Gly --- Ile Cys --- --- Ala Ala Cys Thr Gly Cys   (SEQ ID NO: 245)
--- Gly Thr Cys Gly --- Ile Cys --- Tyr --- Ala Cys Thr Gly Cys   (SEQ ID NO: 246)
--- Gly Thr Cys Gly --- Ile Cys --- Tyr Ala --- Cys Thr Gly Cys   (SEQ ID NO: 247)
--- Gly Thr Cys Gly --- Ile Cys --- Tyr Ala Ala Cys --- Gly Cys   (SEQ ID NO: 248)
--- Gly Thr Cys Gly --- Ile Cys --- Tyr Ala Ala Cys Thr --- Cys   (SEQ ID NO: 249)
--- Gly Thr Cys Gly --- Ile Cys Ala --- Ala Ala Cys Thr Gly Cys   (SEQ ID NO: 250)
--- Gly Thr Cys Gly --- Ile Cys Ala --- --- Ala Cys Thr Gly Cys   (SEQ ID NO: 251)
--- Gly Thr Cys Gly --- Ile Cys Ala --- Ala --- Cys Thr Gly Cys   (SEQ ID NO: 252)
--- Gly Thr Cys Gly --- Ile Cys Ala --- Ala Ala Cys --- Gly Cys   (SEQ ID NO: 253)
--- Gly Thr Cys Gly --- Ile Cys Ala --- Ala Ala Cys Thr --- Cys   (SEQ ID NO: 254)
--- Gly Thr Cys Gly --- Ile Cys Ala Tyr --- Ala Cys Thr Gly Cys   (SEQ ID NO: 255)
--- Gly Thr Cys Gly --- Ile Cys Ala Tyr --- --- Cys Thr Gly Cys   (SEQ ID NO: 256)
--- Gly Thr Cys Gly --- Ile Cys Ala Tyr --- Ala Cys --- Gly Cys   (SEQ ID NO: 257)
--- Gly Thr Cys Gly --- Ile Cys Ala Tyr --- Ala Cys Thr --- Cys   (SEQ ID NO: 258)
--- Gly Thr Cys Gly --- Ile Cys Ala Tyr Ala --- Cys Thr Gly Cys   (SEQ ID NO: 259)
--- Gly Thr Cys Gly --- Ile Cys Ala Tyr Ala --- Cys --- Gly Cys   (SEQ ID NO: 260)
--- Gly Thr Cys Gly --- Ile Cys Ala Tyr Ala --- Cys Thr --- Cys   (SEQ ID NO: 261)
--- Gly Thr Cys Gly --- Ile Cys Ala Tyr Ala Ala Cys --- Gly Cys   (SEQ ID NO: 262)
--- Gly Thr Cys Gly --- Ile Cys Ala Tyr Ala Ala Cys --- --- Cys   (SEQ ID NO: 263)
--- Gly Thr Cys Gly --- Ile Cys Ala Tyr Ala Ala Cys Thr --- Cys   (SEQ ID NO: 264)
--- Gly Thr Cys Gly Glu --- Cys Ala Tyr Ala Ala Cys Thr Gly Cys   (SEQ ID NO: 265)
--- Gly Thr Cys Gly Glu --- Cys --- Tyr Ala Ala Cys Thr Gly Cys   (SEQ ID NO: 266)
--- Gly Thr Cys Gly Glu --- Cys --- --- Ala Ala Cys Thr Gly Cys   (SEQ ID NO: 267)
--- Gly Thr Cys Gly Glu --- Cys --- Tyr --- Ala Cys Thr Gly Cys   (SEQ ID NO: 268)
--- Gly Thr Cys Gly Glu --- Cys --- Tyr Ala --- Cys Thr Gly Cys   (SEQ ID NO: 269)
--- Gly Thr Cys Gly Glu --- Cys --- Tyr Ala Ala Cys --- Gly Cys   (SEQ ID NO: 270)
--- Gly Thr Cys Gly Glu --- Cys --- Tyr Ala Ala Cys Thr --- Cys   (SEQ ID NO: 271)
--- Gly Thr Cys Gly Glu --- Cys Ala --- Ala Ala Cys Thr Gly Cys   (SEQ ID NO: 272)
--- Gly Thr Cys Gly Glu --- Cys Ala --- --- Ala Cys Thr Gly Cys   (SEQ ID NO: 273)
--- Gly Thr Cys Gly Glu --- Cys Ala --- Ala --- Cys Thr Gly Cys   (SEQ ID NO: 274)
--- Gly Thr Cys Gly Glu --- Cys Ala --- Ala Ala Cys --- Gly Cys   (SEQ ID NO: 275)
--- Gly Thr Cys Gly Glu --- Cys Ala --- Ala Ala Cys Thr --- Cys   (SEQ ID NO: 276)
--- Gly Thr Cys Gly Glu --- Cys Ala Tyr --- Ala Cys Thr Gly Cys   (SEQ ID NO: 277)
--- Gly Thr Cys Gly Glu --- Cys Ala Tyr --- --- Cys Thr Gly Cys   (SEQ ID NO: 278)
--- Gly Thr Cys Gly Glu --- Cys Ala Tyr --- Ala Cys --- Gly Cys   (SEQ ID NO: 279)
--- Gly Thr Cys Gly Glu --- Cys Ala Tyr --- Ala Cys Thr --- Cys   (SEQ ID NO: 280)
```

FIG. 1

--- Gly Thr Cys Gly Glu --- Cys Ala Tyr Ala --- Cys Thr Gly Cys (SEQ ID NO: 281)
--- Gly Thr Cys Gly Glu --- Cys Ala Tyr Ala --- Cys --- Gly Cys (SEQ ID NO: 282)
--- Gly Thr Cys Gly Glu --- Cys Ala Tyr Ala --- Cys Thr --- Cys (SEQ ID NO: 283)
--- Gly Thr Cys Gly Glu --- Cys Ala Tyr Ala Ala Cys --- Gly Cys (SEQ ID NO: 284)
--- Gly Thr Cys Gly Glu --- Cys Ala Tyr Ala Ala Cys --- --- Cys (SEQ ID NO: 285)
--- Gly Thr Cys Gly Glu --- Cys Ala Tyr Ala Ala Cys Thr --- Cys (SEQ ID NO: 286)
--- Gly Thr Cys Gly Glu Ile Cys --- Tyr Ala Ala Cys Thr Gly Cys (SEQ ID NO: 287)
--- Gly Thr Cys Gly Glu Ile Cys --- --- Ala Ala Cys Thr Gly Cys (SEQ ID NO: 288)
--- Gly Thr Cys Gly Glu Ile Cys --- --- --- Ala Cys Thr Gly Cys (SEQ ID NO: 289)
--- Gly Thr Cys Gly Glu Ile Cys --- --- Ala --- Cys Thr Gly Cys (SEQ ID NO: 290)
--- Gly Thr Cys Gly Glu Ile Cys --- --- Ala Ala Cys --- Gly Cys (SEQ ID NO: 291)
--- Gly Thr Cys Gly Glu Ile Cys --- --- Ala Ala Cys Thr --- Cys (SEQ ID NO: 292)
--- Gly Thr Cys Gly Glu Ile Cys --- Tyr --- Ala Cys Thr Gly Cys (SEQ ID NO: 293)
--- Gly Thr Cys Gly Glu Ile Cys --- Tyr --- --- Cys Thr Gly Cys (SEQ ID NO: 294)
--- Gly Thr Cys Gly Glu Ile Cys --- Tyr --- Ala Cys --- Gly Cys (SEQ ID NO: 295)
--- Gly Thr Cys Gly Glu Ile Cys --- Tyr --- Ala Cys Thr --- Cys (SEQ ID NO: 296)
--- Gly Thr Cys Gly Glu Ile Cys --- Tyr Ala --- Cys Thr Gly Cys (SEQ ID NO: 297)
--- Gly Thr Cys Gly Glu Ile Cys --- Tyr Ala --- Cys --- Gly Cys (SEQ ID NO: 298)
--- Gly Thr Cys Gly Glu Ile Cys --- Tyr Ala --- Cys Thr --- Cys (SEQ ID NO: 299)
--- Gly Thr Cys Gly Glu Ile Cys --- Tyr Ala Ala Cys --- Gly Cys (SEQ ID NO: 300)
--- Gly Thr Cys Gly Glu Ile Cys --- Tyr Ala Ala Cys --- --- Cys (SEQ ID NO: 301)
--- Gly Thr Cys Gly Glu Ile Cys --- Tyr Ala Ala Cys Thr --- Cys (SEQ ID NO: 302)
--- Gly Thr Cys Gly Glu Ile Cys Ala --- Ala Ala Cys Thr Gly Cys (SEQ ID NO: 303)
--- Gly Thr Cys Gly Glu Ile Cys Ala --- --- Ala Cys Thr Gly Cys (SEQ ID NO: 304)
--- Gly Thr Cys Gly Glu Ile Cys Ala --- --- --- Cys Thr Gly Cys (SEQ ID NO: 305)
--- Gly Thr Cys Gly Glu Ile Cys Ala --- --- Ala Cys --- Gly Cys (SEQ ID NO: 306)
--- Gly Thr Cys Gly Glu Ile Cys Ala --- --- Ala Cys Thr --- Cys (SEQ ID NO: 307)
--- Gly Thr Cys Gly Glu Ile Cys Ala --- Ala --- Cys Thr Gly Cys (SEQ ID NO: 308)
--- Gly Thr Cys Gly Glu Ile Cys Ala --- Ala --- Cys --- Gly Cys (SEQ ID NO: 309)
--- Gly Thr Cys Gly Glu Ile Cys Ala --- Ala --- Cys Thr --- Cys (SEQ ID NO: 310)
--- Gly Thr Cys Gly Glu Ile Cys Ala --- Ala Ala Cys --- Gly Cys (SEQ ID NO: 311)
--- Gly Thr Cys Gly Glu Ile Cys Ala --- Ala Ala Cys --- --- Cys (SEQ ID NO: 312)
--- Gly Thr Cys Gly Glu Ile Cys Ala --- Ala Ala Cys Thr --- Cys (SEQ ID NO: 313)
--- Gly Thr Cys Gly Glu Ile Cys Ala Tyr --- Ala Cys Thr Gly Cys (SEQ ID NO: 314)
--- Gly Thr Cys Gly Glu Ile Cys Ala Tyr --- --- Cys Thr Gly Cys (SEQ ID NO: 315)
--- Gly Thr Cys Gly Glu Ile Cys Ala Tyr --- --- Cys --- Gly Cys (SEQ ID NO: 316)
--- Gly Thr Cys Gly Glu Ile Cys Ala Tyr --- --- Cys Thr --- Cys (SEQ ID NO: 317)
--- Gly Thr Cys Gly Glu Ile Cys Ala Tyr --- Ala Cys --- Gly Cys (SEQ ID NO: 318)
--- Gly Thr Cys Gly Glu Ile Cys Ala Tyr --- Ala Cys --- --- Cys (SEQ ID NO: 319)
--- Gly Thr Cys Gly Glu Ile Cys Ala Tyr --- Ala Cys Thr --- Cys (SEQ ID NO: 320)
--- Gly Thr Cys Gly Glu Ile Cys Ala Tyr Ala --- Cys Thr Gly Cys (SEQ ID NO: 321)
--- Gly Thr Cys Gly Glu Ile Cys Ala Tyr Ala --- Cys --- Gly Cys (SEQ ID NO: 322)
--- Gly Thr Cys Gly Glu Ile Cys Ala Tyr Ala --- Cys --- --- Cys (SEQ ID NO: 323)
--- Gly Thr Cys Gly Glu Ile Cys Ala Tyr Ala --- Cys Thr --- Cys (SEQ ID NO: 324)
--- Gly Thr Cys Gly Glu Ile Cys Ala Tyr Ala Ala Cys --- Gly Cys (SEQ ID NO: 325)
--- Gly Thr Cys Gly Glu Ile Cys Ala Tyr Ala Ala Cys --- --- Cys (SEQ ID NO: 326)
--- Gly Thr Cys Gly Glu Ile Cys Ala Tyr Ala Ala Cys Thr --- Cys (SEQ ID NO: 327)

FIG. 1

```
Pro --- Thr Cys Gly Glu Ile Cys Ala Tyr Ala Ala Cys Thr Gly Cys     (SEQ ID NO: 328)
Pro --- --- Cys Gly Glu Ile Cys Ala Tyr Ala Ala Cys Thr Gly Cys     (SEQ ID NO: 329)
Pro --- --- Cys --- Glu Ile Cys Ala Tyr Ala Ala Cys Thr Gly Cys     (SEQ ID NO: 330)
Pro --- --- Cys --- --- Ile Cys Ala Tyr Ala Ala Cys Thr Gly Cys     (SEQ ID NO: 331)
Pro --- --- Cys --- Glu --- Cys Ala Tyr Ala Ala Cys Thr Gly Cys     (SEQ ID NO: 332)
Pro --- --- Cys --- Glu Ile Cys --- Tyr Ala Ala Cys Thr Gly Cys     (SEQ ID NO: 333)
Pro --- --- Cys --- Glu Ile Cys Ala --- Ala Ala Cys Thr Gly Cys     (SEQ ID NO: 334)
Pro --- --- Cys --- Glu Ile Cys Ala Tyr --- Ala Cys Thr Gly Cys     (SEQ ID NO: 335)
Pro --- --- Cys --- Glu Ile Cys Ala Tyr Ala --- Cys Thr Gly Cys     (SEQ ID NO: 336)
Pro --- --- Cys --- Glu Ile Cys Ala Tyr Ala Ala Cys --- Gly Cys     (SEQ ID NO: 337)
Pro --- --- Cys --- Glu Ile Cys Ala Tyr Ala Ala Cys Thr --- Cys     (SEQ ID NO: 338)
Pro --- --- Cys Gly --- Ile Cys Ala Tyr Ala Ala Cys Thr Gly Cys     (SEQ ID NO: 339)
Pro --- --- Cys Gly --- --- Cys Ala Tyr Ala Ala Cys Thr Gly Cys     (SEQ ID NO: 340)
Pro --- --- Cys Gly --- Ile Cys --- Tyr Ala Ala Cys Thr Gly Cys     (SEQ ID NO: 341)
Pro --- --- Cys Gly --- Ile Cys Ala --- Ala Ala Cys Thr Gly Cys     (SEQ ID NO: 342)
Pro --- --- Cys Gly --- Ile Cys Ala Tyr --- Ala Cys Thr Gly Cys     (SEQ ID NO: 343)
Pro --- --- Cys Gly --- Ile Cys Ala Tyr Ala --- Cys Thr Gly Cys     (SEQ ID NO: 344)
Pro --- --- Cys Gly --- Ile Cys Ala Tyr Ala Ala Cys --- Gly Cys     (SEQ ID NO: 345)
Pro --- --- Cys Gly --- Ile Cys Ala Tyr Ala Ala Cys Thr --- Cys     (SEQ ID NO: 346)
Pro --- --- Cys Gly Glu --- Cys Ala Tyr Ala Ala Cys Thr Gly Cys     (SEQ ID NO: 347)
Pro --- --- Cys Gly Glu --- Cys --- Tyr Ala Ala Cys Thr Gly Cys     (SEQ ID NO: 348)
Pro --- --- Cys Gly Glu --- Cys Ala --- Ala Ala Cys Thr Gly Cys     (SEQ ID NO: 349)
Pro --- --- Cys Gly Glu --- Cys Ala Tyr --- Ala Cys Thr Gly Cys     (SEQ ID NO: 350)
Pro --- --- Cys Gly Glu --- Cys Ala Tyr Ala --- Cys Thr Gly Cys     (SEQ ID NO: 351)
Pro --- --- Cys Gly Glu --- Cys Ala Tyr Ala Ala Cys --- Gly Cys     (SEQ ID NO: 352)
Pro --- --- Cys Gly Glu --- Cys Ala Tyr Ala Ala Cys Thr --- Cys     (SEQ ID NO: 353)
Pro --- --- Cys Gly Glu Ile Cys --- Tyr Ala Ala Cys Thr Gly Cys     (SEQ ID NO: 354)
Pro --- --- Cys Gly Glu Ile Cys --- --- Ala Ala Cys Thr Gly Cys     (SEQ ID NO: 355)
Pro --- --- Cys Gly Glu Ile Cys --- Tyr --- Ala Cys Thr Gly Cys     (SEQ ID NO: 356)
Pro --- --- Cys Gly Glu Ile Cys --- Tyr Ala --- Cys Thr Gly Cys     (SEQ ID NO: 357)
Pro --- --- Cys Gly Glu Ile Cys --- Tyr Ala Ala Cys --- Gly Cys     (SEQ ID NO: 358)
Pro --- --- Cys Gly Glu Ile Cys --- Tyr Ala Ala Cys Thr --- Cys     (SEQ ID NO: 359)
Pro --- --- Cys Gly Glu Ile Cys Ala --- Ala Ala Cys Thr Gly Cys     (SEQ ID NO: 360)
Pro --- --- Cys Gly Glu Ile Cys Ala --- --- Ala Cys Thr Gly Cys     (SEQ ID NO: 361)
Pro --- --- Cys Gly Glu Ile Cys Ala --- Ala --- Cys Thr Gly Cys     (SEQ ID NO: 362)
Pro --- --- Cys Gly Glu Ile Cys Ala --- Ala Ala Cys --- Gly Cys     (SEQ ID NO: 363)
Pro --- --- Cys Gly Glu Ile Cys Ala --- Ala Ala Cys Thr --- Cys     (SEQ ID NO: 364)
Pro --- --- Cys Gly Glu Ile Cys Ala Tyr --- Ala Cys Thr Gly Cys     (SEQ ID NO: 365)
Pro --- --- Cys Gly Glu Ile Cys Ala Tyr --- --- Cys Thr Gly Cys     (SEQ ID NO: 366)
Pro --- --- Cys Gly Glu Ile Cys Ala Tyr --- Ala Cys --- Gly Cys     (SEQ ID NO: 367)
Pro --- --- Cys Gly Glu Ile Cys Ala Tyr --- Ala Cys Thr --- Cys     (SEQ ID NO: 368)
Pro --- --- Cys Gly Glu Ile Cys Ala Tyr Ala --- Cys Thr Gly Cys     (SEQ ID NO: 369)
Pro --- --- Cys Gly Glu Ile Cys Ala Tyr Ala --- Cys --- Gly Cys     (SEQ ID NO: 370)
Pro --- --- Cys Gly Glu Ile Cys Ala Tyr Ala --- Cys Thr --- Cys     (SEQ ID NO: 371)
Pro --- --- Cys Gly Glu Ile Cys Ala Tyr Ala Ala Cys --- Gly Cys     (SEQ ID NO: 372)
Pro --- --- Cys Gly Glu Ile Cys Ala Tyr Ala Ala Cys --- --- Cys     (SEQ ID NO: 373)
Pro --- --- Cys Gly Glu Ile Cys Ala Tyr Ala Ala Cys Thr --- Cys     (SEQ ID NO: 374)
```

FIG. 1

| | | | | | | | | | | | | | | |
|---|---|---|---|---|---|---|---|---|---|---|---|---|---|---|
Pro | --- | Thr | Cys | --- | Glu | Ile | Cys | Ala | Tyr | Ala | Ala | Cys | Thr | Gly | Cys | (SEQ ID NO: 375)
Pro | --- | Thr | Cys | --- | --- | Ile | Cys | Ala | Tyr | Ala | Ala | Cys | Thr | Gly | Cys | (SEQ ID NO: 376)
Pro | --- | Thr | Cys | --- | --- | --- | Cys | Ala | Tyr | Ala | Ala | Cys | Thr | Gly | Cys | (SEQ ID NO: 377)
Pro | --- | Thr | Cys | --- | --- | Ile | Cys | --- | Tyr | Ala | Ala | Cys | Thr | Gly | Cys | (SEQ ID NO: 378)
Pro | --- | Thr | Cys | --- | --- | Ile | Cys | Ala | --- | Ala | Ala | Cys | Thr | Gly | Cys | (SEQ ID NO: 379)
Pro | --- | Thr | Cys | --- | --- | Ile | Cys | Ala | Tyr | --- | Ala | Cys | Thr | Gly | Cys | (SEQ ID NO: 380)
Pro | --- | Thr | Cys | --- | --- | Ile | Cys | Ala | Tyr | Ala | --- | Cys | Thr | Gly | Cys | (SEQ ID NO: 381)
Pro | --- | Thr | Cys | --- | --- | Ile | Cys | Ala | Tyr | Ala | Ala | Cys | --- | Gly | Cys | (SEQ ID NO: 382)
Pro | --- | Thr | Cys | --- | --- | Ile | Cys | Ala | Tyr | Ala | Ala | Cys | Thr | --- | Cys | (SEQ ID NO: 383)
Pro | --- | Thr | Cys | --- | Glu | --- | Cys | Ala | Tyr | Ala | Ala | Cys | Thr | Gly | Cys | (SEQ ID NO: 384)
Pro | --- | Thr | Cys | --- | Glu | --- | Cys | --- | Tyr | Ala | Ala | Cys | Thr | Gly | Cys | (SEQ ID NO: 385)
Pro | --- | Thr | Cys | --- | Glu | --- | Cys | Ala | --- | Ala | Ala | Cys | Thr | Gly | Cys | (SEQ ID NO: 386)
Pro | --- | Thr | Cys | --- | Glu | --- | Cys | Ala | Tyr | --- | Ala | Cys | Thr | Gly | Cys | (SEQ ID NO: 387)
Pro | --- | Thr | Cys | --- | Glu | --- | Cys | Ala | Tyr | Ala | --- | Cys | Thr | Gly | Cys | (SEQ ID NO: 388)
Pro | --- | Thr | Cys | --- | Glu | --- | Cys | Ala | Tyr | Ala | Ala | Cys | --- | Gly | Cys | (SEQ ID NO: 389)
Pro | --- | Thr | Cys | --- | Glu | --- | Cys | Ala | Tyr | Ala | Ala | Cys | Thr | --- | Cys | (SEQ ID NO: 390)
Pro | --- | Thr | Cys | --- | Glu | Ile | Cys | --- | Tyr | Ala | Ala | Cys | Thr | Gly | Cys | (SEQ ID NO: 391)
Pro | --- | Thr | Cys | --- | Glu | Ile | Cys | --- | --- | Ala | Ala | Cys | Thr | Gly | Cys | (SEQ ID NO: 392)
Pro | --- | Thr | Cys | --- | Glu | Ile | Cys | --- | Tyr | --- | Ala | Cys | Thr | Gly | Cys | (SEQ ID NO: 393)
Pro | --- | Thr | Cys | --- | Glu | Ile | Cys | --- | Tyr | Ala | --- | Cys | Thr | Gly | Cys | (SEQ ID NO: 394)
Pro | --- | Thr | Cys | --- | Glu | Ile | Cys | --- | Tyr | Ala | Ala | Cys | --- | Gly | Cys | (SEQ ID NO: 395)
Pro | --- | Thr | Cys | --- | Glu | Ile | Cys | --- | Tyr | Ala | Ala | Cys | Thr | --- | Cys | (SEQ ID NO: 396)
Pro | --- | Thr | Cys | --- | Glu | Ile | Cys | Ala | --- | Ala | Ala | Cys | Thr | Gly | Cys | (SEQ ID NO: 397)
Pro | --- | Thr | Cys | --- | Glu | Ile | Cys | Ala | --- | --- | Ala | Cys | Thr | Gly | Cys | (SEQ ID NO: 398)
Pro | --- | Thr | Cys | --- | Glu | Ile | Cys | Ala | --- | Ala | --- | Cys | Thr | Gly | Cys | (SEQ ID NO: 399)
Pro | --- | Thr | Cys | --- | Glu | Ile | Cys | Ala | --- | Ala | Ala | Cys | --- | Gly | Cys | (SEQ ID NO: 400)
Pro | --- | Thr | Cys | --- | Glu | Ile | Cys | Ala | --- | Ala | Ala | Cys | Thr | --- | Cys | (SEQ ID NO: 401)
Pro | --- | Thr | Cys | --- | Glu | Ile | Cys | Ala | Tyr | --- | Ala | Cys | Thr | Gly | Cys | (SEQ ID NO: 402)
Pro | --- | Thr | Cys | --- | Glu | Ile | Cys | Ala | Tyr | --- | --- | Cys | Thr | Gly | Cys | (SEQ ID NO: 403)
Pro | --- | Thr | Cys | --- | Glu | Ile | Cys | Ala | Tyr | --- | Ala | Cys | --- | Gly | Cys | (SEQ ID NO: 404)
Pro | --- | Thr | Cys | --- | Glu | Ile | Cys | Ala | Tyr | --- | Ala | Cys | Thr | --- | Cys | (SEQ ID NO: 405)
Pro | --- | Thr | Cys | --- | Glu | Ile | Cys | Ala | Tyr | Ala | --- | Cys | Thr | Gly | Cys | (SEQ ID NO: 406)
Pro | --- | Thr | Cys | --- | Glu | Ile | Cys | Ala | Tyr | Ala | --- | Cys | --- | Gly | Cys | (SEQ ID NO: 407)
Pro | --- | Thr | Cys | --- | Glu | Ile | Cys | Ala | Tyr | Ala | --- | Cys | Thr | --- | Cys | (SEQ ID NO: 408)
Pro | --- | Thr | Cys | --- | Glu | Ile | Cys | Ala | Tyr | Ala | Ala | Cys | --- | Gly | Cys | (SEQ ID NO: 409)
Pro | --- | Thr | Cys | --- | Glu | Ile | Cys | Ala | Tyr | Ala | Ala | Cys | --- | --- | Cys | (SEQ ID NO: 410)
Pro | --- | Thr | Cys | --- | Glu | Ile | Cys | Ala | Tyr | Ala | Ala | Cys | Thr | --- | Cys | (SEQ ID NO: 411)
Pro | --- | Thr | Cys | Gly | --- | Ile | Cys | Ala | Tyr | Ala | Ala | Cys | Thr | Gly | Cys | (SEQ ID NO: 412)
Pro | --- | Thr | Cys | Gly | --- | --- | Cys | Ala | Tyr | Ala | Ala | Cys | Thr | Gly | Cys | (SEQ ID NO: 413)
Pro | --- | Thr | Cys | Gly | --- | --- | Cys | --- | Tyr | Ala | Ala | Cys | Thr | Gly | Cys | (SEQ ID NO: 414)
Pro | --- | Thr | Cys | Gly | --- | --- | Cys | Ala | --- | Ala | Ala | Cys | Thr | Gly | Cys | (SEQ ID NO: 415)
Pro | --- | Thr | Cys | Gly | --- | --- | Cys | Ala | Tyr | --- | Ala | Cys | Thr | Gly | Cys | (SEQ ID NO: 416)
Pro | --- | Thr | Cys | Gly | --- | --- | Cys | Ala | Tyr | Ala | --- | Cys | Thr | Gly | Cys | (SEQ ID NO: 417)
Pro | --- | Thr | Cys | Gly | --- | --- | Cys | Ala | Tyr | Ala | Ala | Cys | --- | Gly | Cys | (SEQ ID NO: 418)
Pro | --- | Thr | Cys | Gly | --- | --- | Cys | Ala | Tyr | Ala | Ala | Cys | Thr | --- | Cys | (SEQ ID NO: 419)
Pro | --- | Thr | Cys | Gly | --- | Ile | Cys | --- | Tyr | Ala | Ala | Cys | Thr | Gly | Cys | (SEQ ID NO: 420)
Pro | --- | Thr | Cys | Gly | --- | Ile | Cys | --- | --- | Ala | Ala | Cys | Thr | Gly | Cys | (SEQ ID NO: 421)

FIG. 1

```
Pro --- Thr Cys Gly --- Ile Cys --- Tyr --- Ala Cys Thr Gly Cys   (SEQ ID NO: 422)
Pro --- Thr Cys Gly --- Ile Cys --- Tyr Ala --- Cys Thr Gly Cys   (SEQ ID NO: 423)
Pro --- Thr Cys Gly --- Ile Cys --- Tyr Ala Ala Cys --- Gly Cys   (SEQ ID NO: 424)
Pro --- Thr Cys Gly --- Ile Cys --- Tyr Ala Ala Cys Thr --- Cys   (SEQ ID NO: 425)
Pro --- Thr Cys Gly --- Ile Cys Ala --- Ala Ala Cys Thr Gly Cys   (SEQ ID NO: 426)
Pro --- Thr Cys Gly --- Ile Cys Ala --- --- Ala Cys Thr Gly Cys   (SEQ ID NO: 427)
Pro --- Thr Cys Gly --- Ile Cys Ala --- Ala --- Cys Thr Gly Cys   (SEQ ID NO: 428)
Pro --- Thr Cys Gly --- Ile Cys Ala --- Ala Ala Cys --- Gly Cys   (SEQ ID NO: 429)
Pro --- Thr Cys Gly --- Ile Cys Ala --- Ala Ala Cys Thr --- Cys   (SEQ ID NO: 430)
Pro --- Thr Cys Gly --- Ile Cys Ala Tyr --- Ala Cys Thr Gly Cys   (SEQ ID NO: 431)
Pro --- Thr Cys Gly --- Ile Cys Ala Tyr --- --- Cys Thr Gly Cys   (SEQ ID NO: 432)
Pro --- Thr Cys Gly --- Ile Cys Ala Tyr --- Ala Cys --- Gly Cys   (SEQ ID NO: 433)
Pro --- Thr Cys Gly --- Ile Cys Ala Tyr --- Ala Cys Thr --- Cys   (SEQ ID NO: 434)
Pro --- Thr Cys Gly --- Ile Cys Ala Tyr Ala --- Cys Thr Gly Cys   (SEQ ID NO: 435)
Pro --- Thr Cys Gly --- Ile Cys Ala Tyr Ala --- Cys --- Gly Cys   (SEQ ID NO: 436)
Pro --- Thr Cys Gly --- Ile Cys Ala Tyr Ala --- Cys Thr --- Cys   (SEQ ID NO: 437)
Pro --- Thr Cys Gly --- Ile Cys Ala Tyr Ala Ala Cys --- Gly Cys   (SEQ ID NO: 438)
Pro --- Thr Cys Gly --- Ile Cys Ala Tyr Ala Ala Cys --- --- Cys   (SEQ ID NO: 439)
Pro --- Thr Cys Gly --- Ile Cys Ala Tyr Ala Ala Cys Thr --- Cys   (SEQ ID NO: 440)
Pro --- Thr Cys Gly Glu --- Cys Ala Tyr Ala Ala Cys Thr Gly Cys   (SEQ ID NO: 441)
Pro --- Thr Cys Gly Glu --- Cys --- Tyr Ala Ala Cys Thr Gly Cys   (SEQ ID NO: 442)
Pro --- Thr Cys Gly Glu --- Cys --- --- Ala Ala Cys Thr Gly Cys   (SEQ ID NO: 443)
Pro --- Thr Cys Gly Glu --- Cys --- Tyr --- Ala Cys Thr Gly Cys   (SEQ ID NO: 444)
Pro --- Thr Cys Gly Glu --- Cys --- Tyr Ala --- Cys Thr Gly Cys   (SEQ ID NO: 445)
Pro --- Thr Cys Gly Glu --- Cys --- Tyr Ala Ala Cys --- Gly Cys   (SEQ ID NO: 446)
Pro --- Thr Cys Gly Glu --- Cys --- Tyr Ala Ala Cys Thr --- Cys   (SEQ ID NO: 447)
Pro --- Thr Cys Gly Glu --- Cys Ala --- Ala Ala Cys Thr Gly Cys   (SEQ ID NO: 448)
Pro --- Thr Cys Gly Glu --- Cys Ala --- --- Ala Cys Thr Gly Cys   (SEQ ID NO: 449)
Pro --- Thr Cys Gly Glu --- Cys Ala --- Ala --- Cys Thr Gly Cys   (SEQ ID NO: 450)
Pro --- Thr Cys Gly Glu --- Cys Ala --- Ala Ala Cys --- Gly Cys   (SEQ ID NO: 451)
Pro --- Thr Cys Gly Glu --- Cys Ala --- Ala Ala Cys Thr --- Cys   (SEQ ID NO: 452)
Pro --- Thr Cys Gly Glu --- Cys Ala Tyr --- Ala Cys Thr Gly Cys   (SEQ ID NO: 453)
Pro --- Thr Cys Gly Glu --- Cys Ala Tyr --- --- Cys Thr Gly Cys   (SEQ ID NO: 454)
Pro --- Thr Cys Gly Glu --- Cys Ala Tyr --- Ala Cys --- Gly Cys   (SEQ ID NO: 455)
Pro --- Thr Cys Gly Glu --- Cys Ala Tyr --- Ala Cys Thr --- Cys   (SEQ ID NO: 456)
Pro --- Thr Cys Gly Glu --- Cys Ala Tyr Ala --- Cys Thr Gly Cys   (SEQ ID NO: 457)
Pro --- Thr Cys Gly Glu --- Cys Ala Tyr Ala --- Cys --- Gly Cys   (SEQ ID NO: 458)
Pro --- Thr Cys Gly Glu --- Cys Ala Tyr Ala --- Cys Thr --- Cys   (SEQ ID NO: 459)
Pro --- Thr Cys Gly Glu --- Cys Ala Tyr Ala Ala Cys --- Gly Cys   (SEQ ID NO: 460)
Pro --- Thr Cys Gly Glu --- Cys Ala Tyr Ala Ala Cys --- --- Cys   (SEQ ID NO: 461)
Pro --- Thr Cys Gly Glu --- Cys Ala Tyr Ala Ala Cys Thr --- Cys   (SEQ ID NO: 462)
Pro --- Thr Cys Gly Glu Ile Cys --- Tyr Ala Ala Cys Thr Gly Cys   (SEQ ID NO: 463)
Pro --- Thr Cys Gly·Glu Ile Cys --- --- Ala Ala Cys Thr Gly Cys   (SEQ ID NO: 464)
Pro --- Thr Cys Gly Glu Ile Cys --- --- --- Ala Cys Thr Gly Cys   (SEQ ID NO: 465)
Pro --- Thr Cys Gly Glu Ile Cys --- --- Ala --- Cys Thr Gly Cys   (SEQ ID NO: 466)
Pro --- Thr Cys Gly Glu Ile Cys --- --- Ala Ala Cys --- Gly Cys   (SEQ ID NO: 467)
Pro --- Thr Cys Gly Glu Ile Cys --- --- Ala Ala Cys Thr --- Cys   (SEQ ID NO: 468)
```

FIG. 1

```
Pro --- Thr Cys Gly Glu Ile Cys --- Tyr --- Ala Cys Thr Gly Cys   (SEQ ID NO: 469)
Pro --- Thr Cys Gly Glu Ile Cys --- Tyr --- --- Cys Thr Gly Cys   (SEQ ID NO: 470)
Pro --- Thr Cys Gly Glu Ile Cys --- Tyr --- Ala Cys --- Gly Cys   (SEQ ID NO: 471)
Pro --- Thr Cys Gly Glu Ile Cys --- Tyr --- Ala Cys Thr --- Cys   (SEQ ID NO: 472)
Pro --- Thr Cys Gly Glu Ile Cys --- Tyr Ala --- Cys Thr Gly Cys   (SEQ ID NO: 473)
Pro --- Thr Cys Gly Glu Ile Cys --- Tyr Ala --- Cys --- Gly Cys   (SEQ ID NO: 474)
Pro --- Thr Cys Gly Glu Ile Cys --- Tyr Ala --- Cys Thr --- Cys   (SEQ ID NO: 475)
Pro --- Thr Cys Gly Glu Ile Cys --- Tyr Ala Ala Cys --- Gly Cys   (SEQ ID NO: 476)
Pro --- Thr Cys Gly Glu Ile Cys --- Tyr Ala Ala Cys --- --- Cys   (SEQ ID NO: 477)
Pro --- Thr Cys Gly Glu Ile Cys --- Tyr Ala Ala Cys Thr --- Cys   (SEQ ID NO: 478)
Pro --- Thr Cys Gly Glu Ile Cys Ala --- Ala Ala Cys Thr Gly Cys   (SEQ ID NO: 479)
Pro --- Thr Cys Gly Glu Ile Cys Ala --- --- Ala Cys Thr Gly Cys   (SEQ ID NO: 480)
Pro --- Thr Cys Gly Glu Ile Cys Ala --- --- --- Cys Thr Gly Cys   (SEQ ID NO: 481)
Pro --- Thr Cys Gly Glu Ile Cys Ala --- --- Ala Cys --- Gly Cys   (SEQ ID NO: 482)
Pro --- Thr Cys Gly Glu Ile Cys Ala --- --- Ala Cys Thr --- Cys   (SEQ ID NO: 483)
Pro --- Thr Cys Gly Glu Ile Cys Ala --- Ala --- Cys Thr Gly Cys   (SEQ ID NO: 484)
Pro --- Thr Cys Gly Glu Ile Cys Ala --- Ala --- Cys --- Gly Cys   (SEQ ID NO: 485)
Pro --- Thr Cys Gly Glu Ile Cys Ala --- Ala --- Cys Thr --- Cys   (SEQ ID NO: 486)
Pro --- Thr Cys Gly Glu Ile Cys Ala --- Ala Ala Cys --- Gly Cys   (SEQ ID NO: 487)
Pro --- Thr Cys Gly Glu Ile Cys Ala --- Ala Ala Cys --- --- Cys   (SEQ ID NO: 488)
Pro --- Thr Cys Gly Glu Ile Cys Ala --- Ala Ala Cys Thr --- Cys   (SEQ ID NO: 489)
Pro --- Thr Cys Gly Glu Ile Cys Ala Tyr --- Ala Cys Thr Gly Cys   (SEQ ID NO: 490)
Pro --- Thr Cys Gly Glu Ile Cys Ala Tyr --- --- Cys Thr Gly Cys   (SEQ ID NO: 491)
Pro --- Thr Cys Gly Glu Ile Cys Ala Tyr --- --- Cys --- Gly Cys   (SEQ ID NO: 492)
Pro --- Thr Cys Gly Glu Ile Cys Ala Tyr --- --- Cys Thr --- Cys   (SEQ ID NO: 493)
Pro --- Thr Cys Gly Glu Ile Cys Ala Tyr --- Ala Cys --- Gly Cys   (SEQ ID NO: 494)
Pro --- Thr Cys Gly Glu Ile Cys Ala Tyr --- Ala Cys --- --- Cys   (SEQ ID NO: 495)
Pro --- Thr Cys Gly Glu Ile Cys Ala Tyr --- Ala Cys Thr --- Cys   (SEQ ID NO: 496)
Pro --- Thr Cys Gly Glu Ile Cys Ala Tyr Ala --- Cys Thr Gly Cys   (SEQ ID NO: 497)
Pro --- Thr Cys Gly Glu Ile Cys Ala Tyr Ala --- Cys --- Gly Cys   (SEQ ID NO: 498)
Pro --- Thr Cys Gly Glu Ile Cys Ala Tyr Ala --- Cys --- --- Cys   (SEQ ID NO: 499)
Pro --- Thr Cys Gly Glu Ile Cys Ala Tyr Ala --- Cys Thr --- Cys   (SEQ ID NO: 500)
Pro --- Thr Cys Gly Glu Ile Cys Ala Tyr Ala Ala Cys --- Gly Cys   (SEQ ID NO: 501)
Pro --- Thr Cys Gly Glu Ile Cys Ala Tyr Ala Ala Cys --- --- Cys   (SEQ ID NO: 502)
Pro --- Thr Cys Gly Glu Ile Cys Ala Tyr Ala Ala Cys Thr --- Cys   (SEQ ID NO: 503)
Pro Gly --- Cys Gly Glu Ile Cys Ala Tyr Ala Ala Cys Thr Gly Cys   (SEQ ID NO: 504)
Pro Gly --- Cys --- Glu Ile Cys Ala Tyr Ala Ala Cys Thr Gly Cys   (SEQ ID NO: 505)
Pro Gly --- Cys --- --- Ile Cys Ala Tyr Ala Ala Cys Thr Gly Cys   (SEQ ID NO: 506)
Pro Gly --- Cys --- --- --- Cys Ala Tyr Ala Ala Cys Thr Gly Cys   (SEQ ID NO: 507)
Pro Gly --- Cys --- --- Ile Cys --- Tyr Ala Ala Cys Thr Gly Cys   (SEQ ID NO: 508)
Pro Gly --- Cys --- --- Ile Cys Ala --- Ala Ala Cys Thr Gly Cys   (SEQ ID NO: 509)
Pro Gly --- Cys --- --- Ile Cys Ala Tyr --- Ala Cys Thr Gly Cys   (SEQ ID NO: 510)
Pro Gly --- Cys --- --- Ile Cys Ala Tyr Ala --- Cys Thr Gly Cys   (SEQ ID NO: 511)
Pro Gly --- Cys --- --- Ile Cys Ala Tyr Ala Ala Cys --- Gly Cys   (SEQ ID NO: 512)
Pro Gly --- Cys --- --- Ile Cys Ala Tyr Ala Ala Cys Thr --- Cys   (SEQ ID NO: 513)
Pro Gly --- Cys --- Glu --- Cys Ala Tyr Ala Ala Cys Thr Gly Cys   (SEQ ID NO: 514)
Pro Gly --- Cys --- Glu --- Cys --- Tyr Ala Ala Cys Thr Gly Cys   (SEQ ID NO: 515)
```

FIG. 1

```
Pro Gly --- Cys --- Glu --- Cys Ala --- Ala Ala Cys Thr Gly Cys    (SEQ ID NO: 516)
Pro Gly --- Cys --- Glu --- Cys Ala Tyr --- Ala Cys Thr Gly Cys    (SEQ ID NO: 517)
Pro Gly --- Cys --- Glu --- Cys Ala Tyr Ala --- Cys Thr Gly Cys    (SEQ ID NO: 518)
Pro Gly --- Cys --- Glu --- Cys Ala Tyr Ala Ala Cys --- Gly Cys    (SEQ ID NO: 519)
Pro Gly --- Cys --- Glu --- Cys Ala Tyr Ala Ala Cys Thr --- Cys    (SEQ ID NO: 520)
Pro Gly --- Cys --- Glu Ile Cys --- Tyr Ala Ala Cys Thr Gly Cys    (SEQ ID NO: 521)
Pro Gly --- Cys --- Glu Ile Cys --- --- Ala Ala Cys Thr Gly Cys    (SEQ ID NO: 522)
Pro Gly --- Cys --- Glu Ile Cys --- Tyr --- Ala Cys Thr Gly Cys    (SEQ ID NO: 523)
Pro Gly --- Cys --- Glu Ile Cys --- Tyr Ala --- Cys Thr Gly Cys    (SEQ ID NO: 524)
Pro Gly --- Cys --- Glu Ile Cys --- Tyr Ala Ala Cys --- Gly Cys    (SEQ ID NO: 525)
Pro Gly --- Cys --- Glu Ile Cys --- Tyr Ala Ala Cys Thr --- Cys    (SEQ ID NO: 526)
Pro Gly --- Cys --- Glu Ile Cys Ala --- Ala Ala Cys Thr Gly Cys    (SEQ ID NO: 527)
Pro Gly --- Cys --- Glu Ile Cys Ala --- --- Ala Cys Thr Gly Cys    (SEQ ID NO: 528)
Pro Gly --- Cys --- Glu Ile Cys Ala --- Ala --- Cys Thr Gly Cys    (SEQ ID NO: 529)
Pro Gly --- Cys --- Glu Ile Cys Ala --- Ala Ala Cys --- Gly Cys    (SEQ ID NO: 530)
Pro Gly --- Cys --- Glu Ile Cys Ala --- Ala Ala Cys Thr --- Cys    (SEQ ID NO: 531)
Pro Gly --- Cys --- Glu Ile Cys Ala Tyr --- Ala Cys Thr Gly Cys    (SEQ ID NO: 532)
Pro Gly --- Cys --- Glu Ile Cys Ala Tyr --- --- Cys Thr Gly Cys    (SEQ ID NO: 533)
Pro Gly --- Cys --- Glu Ile Cys Ala Tyr --- Ala Cys --- Gly Cys    (SEQ ID NO: 534)
Pro Gly --- Cys --- Glu Ile Cys Ala Tyr --- Ala Cys Thr --- Cys    (SEQ ID NO: 535)
Pro Gly --- Cys --- Glu Ile Cys Ala Tyr Ala --- Cys Thr Gly Cys    (SEQ ID NO: 536)
Pro Gly --- Cys --- Glu Ile Cys Ala Tyr Ala --- Cys --- Gly Cys    (SEQ ID NO: 537)
Pro Gly --- Cys --- Glu Ile Cys Ala Tyr Ala --- Cys Thr --- Cys    (SEQ ID NO: 538)
Pro Gly --- Cys --- Glu Ile Cys Ala Tyr Ala Ala Cys --- Gly Cys    (SEQ ID NO: 539)
Pro Gly --- Cys --- Glu Ile Cys Ala Tyr Ala Ala Cys --- --- Cys    (SEQ ID NO: 540)
Pro Gly --- Cys --- Glu Ile Cys Ala Tyr Ala Ala Cys Thr --- Cys    (SEQ ID NO: 541)
Pro Gly --- Cys Gly --- Ile Cys Ala Tyr Ala Ala Cys Thr Gly Cys    (SEQ ID NO: 542)
Pro Gly --- Cys Gly --- --- Cys Ala Tyr Ala Ala Cys Thr Gly Cys    (SEQ ID NO: 543)
Pro Gly --- Cys Gly --- --- Cys --- Tyr Ala Ala Cys Thr Gly Cys    (SEQ ID NO: 544)
Pro Gly --- Cys Gly --- --- Cys Ala --- Ala Ala Cys Thr Gly Cys    (SEQ ID NO: 545)
Pro Gly --- Cys Gly --- --- Cys Ala Tyr --- Ala Cys Thr Gly Cys    (SEQ ID NO: 546)
Pro Gly --- Cys Gly --- --- Cys Ala Tyr Ala --- Cys Thr Gly Cys    (SEQ ID NO: 547)
Pro Gly --- Cys Gly --- --- Cys Ala Tyr Ala Ala Cys --- Gly Cys    (SEQ ID NO: 548)
Pro Gly --- Cys Gly --- --- Cys Ala Tyr Ala Ala Cys Thr --- Cys    (SEQ ID NO: 549)
Pro Gly --- Cys Gly --- Ile Cys --- Tyr Ala Ala Cys Thr Gly Cys    (SEQ ID NO: 550)
Pro Gly --- Cys Gly --- Ile Cys --- --- Ala Ala Cys Thr Gly Cys    (SEQ ID NO: 551)
Pro Gly --- Cys Gly --- Ile Cys --- Tyr --- Ala Cys Thr Gly Cys    (SEQ ID NO: 552)
Pro Gly --- Cys Gly --- Ile Cys --- Tyr Ala --- Cys Thr Gly Cys    (SEQ ID NO: 553)
Pro Gly --- Cys Gly --- Ile Cys --- Tyr Ala Ala Cys --- Gly Cys    (SEQ ID NO: 554)
Pro Gly --- Cys Gly --- Ile Cys --- Tyr Ala Ala Cys Thr --- Cys    (SEQ ID NO: 555)
Pro Gly --- Cys Gly --- Ile Cys Ala --- Ala Ala Cys Thr Gly Cys    (SEQ ID NO: 556)
Pro Gly --- Cys Gly --- Ile Cys Ala --- --- Ala Cys Thr Gly Cys    (SEQ ID NO: 557)
Pro Gly --- Cys Gly --- Ile Cys Ala --- Ala --- Cys Thr Gly Cys    (SEQ ID NO: 558)
Pro Gly --- Cys Gly --- Ile Cys Ala --- Ala Ala Cys --- Gly Cys    (SEQ ID NO: 559)
Pro Gly --- Cys Gly --- Ile Cys Ala --- Ala Ala Cys Thr --- Cys    (SEQ ID NO: 560)
Pro Gly --- Cys Gly --- Ile Cys Ala Tyr --- Ala Cys Thr Gly Cys    (SEQ ID NO: 561)
Pro Gly --- Cys Gly --- Ile Cys Ala Tyr --- --- Cys Thr Gly Cys    (SEQ ID NO: 562)
```

FIG. 1

| | | | | | | | | | | | | |
|---|---|---|---|---|---|---|---|---|---|---|---|---|
| Pro | Gly | --- | Cys | Gly | --- | Ile | Cys | Ala | Tyr | --- | Ala | Cys | --- | Gly | Cys | (SEQ ID NO: 563) |
| Pro | Gly | --- | Cys | Gly | --- | Ile | Cys | Ala | Tyr | --- | Ala | Cys | Thr | --- | Cys | (SEQ ID NO: 564) |
| Pro | Gly | --- | Cys | Gly | --- | Ile | Cys | Ala | Tyr | Ala | --- | Cys | Thr | Gly | Cys | (SEQ ID NO: 565) |
| Pro | Gly | --- | Cys | Gly | --- | Ile | Cys | Ala | Tyr | Ala | --- | Cys | --- | Gly | Cys | (SEQ ID NO: 566) |
| Pro | Gly | --- | Cys | Gly | --- | Ile | Cys | Ala | Tyr | Ala | --- | Cys | Thr | --- | Cys | (SEQ ID NO: 567) |
| Pro | Gly | --- | Cys | Gly | --- | Ile | Cys | Ala | Tyr | Ala | Ala | Cys | --- | Gly | Cys | (SEQ ID NO: 568) |
| Pro | Gly | --- | Cys | Gly | --- | Ile | Cys | Ala | Tyr | Ala | Ala | Cys | --- | --- | Cys | (SEQ ID NO: 569) |
| Pro | Gly | --- | Cys | Gly | --- | Ile | Cys | Ala | Tyr | Ala | Ala | Cys | Thr | --- | Cys | (SEQ ID NO: 570) |
| Pro | Gly | --- | Cys | Gly | Glu | --- | Cys | Ala | Tyr | Ala | Ala | Cys | Thr | Gly | Cys | (SEQ ID NO: 571) |
| Pro | Gly | --- | Cys | Gly | Glu | --- | Cys | --- | Tyr | Ala | Ala | Cys | Thr | Gly | Cys | (SEQ ID NO: 572) |
| Pro | Gly | --- | Cys | Gly | Glu | --- | Cys | --- | --- | Ala | Ala | Cys | Thr | Gly | Cys | (SEQ ID NO: 573) |
| Pro | Gly | --- | Cys | Gly | Glu | --- | Cys | --- | Tyr | --- | Ala | Cys | Thr | Gly | Cys | (SEQ ID NO: 574) |
| Pro | Gly | --- | Cys | Gly | Glu | --- | Cys | --- | Tyr | Ala | --- | Cys | Thr | Gly | Cys | (SEQ ID NO: 575) |
| Pro | Gly | --- | Cys | Gly | Glu | --- | Cys | --- | Tyr | Ala | Ala | Cys | --- | Gly | Cys | (SEQ ID NO: 576) |
| Pro | Gly | --- | Cys | Gly | Glu | --- | Cys | --- | Tyr | Ala | Ala | Cys | Thr | --- | Cys | (SEQ ID NO: 577) |
| Pro | Gly | --- | Cys | Gly | Glu | --- | Cys | Ala | --- | Ala | Ala | Cys | Thr | Gly | Cys | (SEQ ID NO: 578) |
| Pro | Gly | --- | Cys | Gly | Glu | --- | Cys | Ala | --- | --- | Ala | Cys | Thr | Gly | Cys | (SEQ ID NO: 579) |
| Pro | Gly | --- | Cys | Gly | Glu | --- | Cys | Ala | --- | Ala | --- | Cys | Thr | Gly | Cys | (SEQ ID NO: 580) |
| Pro | Gly | --- | Cys | Gly | Glu | --- | Cys | Ala | --- | Ala | Ala | Cys | --- | Gly | Cys | (SEQ ID NO: 581) |
| Pro | Gly | --- | Cys | Gly | Glu | --- | Cys | Ala | --- | Ala | Ala | Cys | Thr | --- | Cys | (SEQ ID NO: 582) |
| Pro | Gly | --- | Cys | Gly | Glu | --- | Cys | Ala | Tyr | --- | Ala | Cys | Thr | Gly | Cys | (SEQ ID NO: 583) |
| Pro | Gly | --- | Cys | Gly | Glu | --- | Cys | Ala | Tyr | --- | --- | Cys | Thr | Gly | Cys | (SEQ ID NO: 584) |
| Pro | Gly | --- | Cys | Gly | Glu | --- | Cys | Ala | Tyr | --- | Ala | Cys | --- | Gly | Cys | (SEQ ID NO: 585) |
| Pro | Gly | --- | Cys | Gly | Glu | --- | Cys | Ala | Tyr | --- | Ala | Cys | Thr | --- | Cys | (SEQ ID NO: 586) |
| Pro | Gly | --- | Cys | Gly | Glu | --- | Cys | Ala | Tyr | Ala | --- | Cys | Thr | Gly | Cys | (SEQ ID NO: 587) |
| Pro | Gly | --- | Cys | Gly | Glu | --- | Cys | Ala | Tyr | Ala | --- | Cys | --- | Gly | Cys | (SEQ ID NO: 588) |
| Pro | Gly | --- | Cys | Gly | Glu | --- | Cys | Ala | Tyr | Ala | --- | Cys | Thr | --- | Cys | (SEQ ID NO: 589) |
| Pro | Gly | --- | Cys | Gly | Glu | --- | Cys | Ala | Tyr | Ala | Ala | Cys | --- | Gly | Cys | (SEQ ID NO: 590) |
| Pro | Gly | --- | Cys | Gly | Glu | --- | Cys | Ala | Tyr | Ala | Ala | Cys | --- | --- | Cys | (SEQ ID NO: 591) |
| Pro | Gly | --- | Cys | Gly | Glu | --- | Cys | Ala | Tyr | Ala | Ala | Cys | Thr | --- | Cys | (SEQ ID NO: 592) |
| Pro | Gly | --- | Cys | Gly | Glu | Ile | Cys | --- | Tyr | Ala | Ala | Cys | Thr | Gly | Cys | (SEQ ID NO: 593) |
| Pro | Gly | --- | Cys | Gly | Glu | Ile | Cys | --- | --- | Ala | Ala | Cys | Thr | Gly | Cys | (SEQ ID NO: 594) |
| Pro | Gly | --- | Cys | Gly | Glu | Ile | Cys | --- | --- | --- | Ala | Cys | Thr | Gly | Cys | (SEQ ID NO: 595) |
| Pro | Gly | --- | Cys | Gly | Glu | Ile | Cys | --- | --- | Ala | --- | Cys | Thr | Gly | Cys | (SEQ ID NO: 596) |
| Pro | Gly | --- | Cys | Gly | Glu | Ile | Cys | --- | --- | Ala | Ala | Cys | --- | Gly | Cys | (SEQ ID NO: 597) |
| Pro | Gly | --- | Cys | Gly | Glu | Ile | Cys | --- | --- | Ala | Ala | Cys | Thr | --- | Cys | (SEQ ID NO: 598) |
| Pro | Gly | --- | Cys | Gly | Glu | Ile | Cys | --- | Tyr | --- | Ala | Cys | Thr | Gly | Cys | (SEQ ID NO: 599) |
| Pro | Gly | --- | Cys | Gly | Glu | Ile | Cys | --- | Tyr | --- | --- | Cys | Thr | Gly | Cys | (SEQ ID NO: 600) |
| Pro | Gly | --- | Cys | Gly | Glu | Ile | Cys | --- | Tyr | --- | Ala | Cys | --- | Gly | Cys | (SEQ ID NO: 601) |
| Pro | Gly | --- | Cys | Gly | Glu | Ile | Cys | --- | Tyr | --- | Ala | Cys | Thr | --- | Cys | (SEQ ID NO: 602) |
| Pro | Gly | --- | Cys | Gly | Glu | Ile | Cys | --- | Tyr | Ala | --- | Cys | Thr | Gly | Cys | (SEQ ID NO: 603) |
| Pro | Gly | --- | Cys | Gly | Glu | Ile | Cys | --- | Tyr | Ala | --- | Cys | --- | Gly | Cys | (SEQ ID NO: 604) |
| Pro | Gly | --- | Cys | Gly | Glu | Ile | Cys | --- | Tyr | Ala | --- | Cys | Thr | --- | Cys | (SEQ ID NO: 605) |
| Pro | Gly | --- | Cys | Gly | Glu | Ile | Cys | --- | Tyr | Ala | Ala | Cys | --- | Gly | Cys | (SEQ ID NO: 606) |
| Pro | Gly | --- | Cys | Gly | Glu | Ile | Cys | --- | Tyr | Ala | Ala | Cys | --- | --- | Cys | (SEQ ID NO: 607) |
| Pro | Gly | --- | Cys | Gly | Glu | Ile | Cys | --- | Tyr | Ala | Ala | Cys | Thr | --- | Cys | (SEQ ID NO: 608) |
| Pro | Gly | --- | Cys | Gly | Glu | Ile | Cys | Ala | --- | Ala | Ala | Cys | Thr | Gly | Cys | (SEQ ID NO: 609) |

FIG. 1

| | |
|---|---|
| Pro Gly --- Cys Gly Glu Ile Cys Ala --- --- Ala Cys Thr Gly Cys | (SEQ ID NO: 610) |
| Pro Gly --- Cys Gly Glu Ile Cys Ala --- --- --- Cys Thr Gly Cys | (SEQ ID NO: 611) |
| Pro Gly --- Cys Gly Glu Ile Cys Ala --- --- Ala Cys --- Gly Cys | (SEQ ID NO: 612) |
| Pro Gly --- Cys Gly Glu Ile Cys Ala --- --- Ala Cys Thr --- Cys | (SEQ ID NO: 613) |
| Pro Gly --- Cys Gly Glu Ile Cys Ala --- Ala --- Cys Thr Gly Cys | (SEQ ID NO: 614) |
| Pro Gly --- Cys Gly Glu Ile Cys Ala --- Ala --- Cys --- Gly Cys | (SEQ ID NO: 615) |
| Pro Gly --- Cys Gly Glu Ile Cys Ala --- Ala --- Cys Thr --- Cys | (SEQ ID NO: 616) |
| Pro Gly --- Cys Gly Glu Ile Cys Ala --- Ala Ala Cys --- Gly Cys | (SEQ ID NO: 617) |
| Pro Gly --- Cys Gly Glu Ile Cys Ala --- Ala Ala Cys --- --- Cys | (SEQ ID NO: 618) |
| Pro Gly --- Cys Gly Glu Ile Cys Ala --- Ala Ala Cys Thr --- Cys | (SEQ ID NO: 619) |
| Pro Gly --- Cys Gly Glu Ile Cys Ala Tyr --- Ala Cys Thr Gly Cys | (SEQ ID NO: 620) |
| Pro Gly --- Cys Gly Glu Ile Cys Ala Tyr --- --- Cys Thr Gly Cys | (SEQ ID NO: 621) |
| Pro Gly --- Cys Gly Glu Ile Cys Ala Tyr --- --- Cys --- Gly Cys | (SEQ ID NO: 622) |
| Pro Gly --- Cys Gly Glu Ile Cys Ala Tyr --- --- Cys Thr --- Cys | (SEQ ID NO: 623) |
| Pro Gly --- Cys Gly Glu Ile Cys Ala Tyr --- Ala Cys --- Gly Cys | (SEQ ID NO: 624) |
| Pro Gly --- Cys Gly Glu Ile Cys Ala Tyr --- Ala Cys --- --- Cys | (SEQ ID NO: 625) |
| Pro Gly --- Cys Gly Glu Ile Cys Ala Tyr --- Ala Cys Thr --- Cys | (SEQ ID NO: 626) |
| Pro Gly --- Cys Gly Glu Ile Cys Ala Tyr Ala --- Cys Thr Gly Cys | (SEQ ID NO: 627) |
| Pro Gly --- Cys Gly Glu Ile Cys Ala Tyr Ala --- Cys --- Gly Cys | (SEQ ID NO: 628) |
| Pro Gly --- Cys Gly Glu Ile Cys Ala Tyr Ala --- Cys --- --- Cys | (SEQ ID NO: 629) |
| Pro Gly --- Cys Gly Glu Ile Cys Ala Tyr Ala --- Cys Thr --- Cys | (SEQ ID NO: 630) |
| Pro Gly --- Cys Gly Glu Ile Cys Ala Tyr Ala Ala Cys --- Gly Cys | (SEQ ID NO: 631) |
| Pro Gly --- Cys Gly Glu Ile Cys Ala Tyr Ala Ala Cys --- --- Cys | (SEQ ID NO: 632) |
| Pro Gly --- Cys Gly Glu Ile Cys Ala Tyr Ala Ala Cys Thr --- Cys | (SEQ ID NO: 633) |
| Pro Gly Thr Cys --- Glu Ile Cys Ala Tyr Ala Ala Cys Thr Gly Cys | (SEQ ID NO: 634) |
| Pro Gly Thr Cys --- --- Ile Cys Ala Tyr Ala Ala Cys Thr Gly Cys | (SEQ ID NO: 635) |
| Pro Gly Thr Cys --- --- --- Cys Ala Tyr Ala Ala Cys Thr Gly Cys | (SEQ ID NO: 636) |
| Pro Gly Thr Cys --- --- --- Cys --- Tyr Ala Ala Cys Thr Gly Cys | (SEQ ID NO: 637) |
| Pro Gly Thr Cys --- --- --- Cys Ala --- Ala Ala Cys Thr Gly Cys | (SEQ ID NO: 638) |
| Pro Gly Thr Cys --- --- --- Cys Ala Tyr --- Ala Cys Thr Gly Cys | (SEQ ID NO: 639) |
| Pro Gly Thr Cys --- --- --- Cys Ala Tyr Ala --- Cys Thr Gly Cys | (SEQ ID NO: 640) |
| Pro Gly Thr Cys --- --- --- Cys Ala Tyr Ala Ala Cys --- Gly Cys | (SEQ ID NO: 641) |
| Pro Gly Thr Cys --- --- --- Cys Ala Tyr Ala Ala Cys Thr --- Cys | (SEQ ID NO: 642) |
| Pro Gly Thr Cys --- --- Ile Cys --- Tyr Ala Ala Cys Thr Gly Cys | (SEQ ID NO: 643) |
| Pro Gly Thr Cys --- --- Ile Cys --- --- Ala Ala Cys Thr Gly Cys | (SEQ ID NO: 644) |
| Pro Gly Thr Cys --- --- Ile Cys --- Tyr --- Ala Cys Thr Gly Cys | (SEQ ID NO: 645) |
| Pro Gly Thr Cys --- --- Ile Cys --- Tyr Ala --- Cys Thr Gly Cys | (SEQ ID NO: 646) |
| Pro Gly Thr Cys --- --- Ile Cys --- Tyr Ala Ala Cys --- Gly Cys | (SEQ ID NO: 647) |
| Pro Gly Thr Cys --- --- Ile Cys --- Tyr Ala Ala Cys Thr --- Cys | (SEQ ID NO: 648) |
| Pro Gly Thr Cys --- --- Ile Cys Ala --- Ala Ala Cys Thr Gly Cys | (SEQ ID NO: 649) |
| Pro Gly Thr Cys --- --- Ile Cys Ala --- --- Ala Cys Thr Gly Cys | (SEQ ID NO: 650) |
| Pro Gly Thr Cys --- --- Ile Cys Ala --- Ala --- Cys Thr Gly Cys | (SEQ ID NO: 651) |
| Pro Gly Thr Cys --- --- Ile Cys Ala --- Ala Ala Cys --- Gly Cys | (SEQ ID NO: 652) |
| Pro Gly Thr Cys --- --- Ile Cys Ala --- Ala Ala Cys Thr --- Cys | (SEQ ID NO: 653) |
| Pro Gly Thr Cys --- --- Ile Cys Ala Tyr --- Ala Cys Thr Gly Cys | (SEQ ID NO: 654) |
| Pro Gly Thr Cys --- --- Ile Cys Ala Tyr --- --- Cys Thr Gly Cys | (SEQ ID NO: 655) |
| Pro Gly Thr Cys --- --- Ile Cys Ala Tyr --- Ala Cys --- Gly Cys | (SEQ ID NO: 656) |

FIG. 1

```
Pro Gly Thr Cys --- --- Ile Cys Ala Tyr --- Ala Cys Thr --- Cys    (SEQ ID NO: 657)
Pro Gly Thr Cys --- --- Ile Cys Ala Tyr Ala --- Cys Thr Gly Cys    (SEQ ID NO: 658)
Pro Gly Thr Cys --- --- Ile Cys Ala Tyr Ala --- Cys --- Gly Cys    (SEQ ID NO: 659)
Pro Gly Thr Cys --- --- Ile Cys Ala Tyr Ala --- Cys Thr --- Cys    (SEQ ID NO: 660)
Pro Gly Thr Cys --- --- Ile Cys Ala Tyr Ala Ala Cys --- Gly Cys    (SEQ ID NO: 661)
Pro Gly Thr Cys --- --- Ile Cys Ala Tyr Ala Ala Cys --- --- Cys    (SEQ ID NO: 662)
Pro Gly Thr Cys --- --- Ile Cys Ala Tyr Ala Ala Cys Thr --- Cys    (SEQ ID NO: 663)
Pro Gly Thr Cys --- Glu --- Cys Ala Tyr Ala Ala Cys Thr Gly Cys    (SEQ ID NO: 664)
Pro Gly Thr Cys --- Glu --- Cys --- Tyr Ala Ala Cys Thr Gly Cys    (SEQ ID NO: 665)
Pro Gly Thr Cys --- Glu --- Cys --- --- Ala Ala Cys Thr Gly Cys    (SEQ ID NO: 666)
Pro Gly Thr Cys --- Glu --- Cys --- Tyr --- Ala Cys Thr Gly Cys    (SEQ ID NO: 667)
Pro Gly Thr Cys --- Glu --- Cys --- Tyr Ala --- Cys Thr Gly Cys    (SEQ ID NO: 668)
Pro Gly Thr Cys --- Glu --- Cys --- Tyr Ala Ala Cys --- Gly Cys    (SEQ ID NO: 669)
Pro Gly Thr Cys --- Glu --- Cys --- Tyr Ala Ala Cys Thr --- Cys    (SEQ ID NO: 670)
Pro Gly Thr Cys --- Glu --- Cys Ala --- Ala Ala Cys Thr Gly Cys    (SEQ ID NO: 671)
Pro Gly Thr Cys --- Glu --- Cys Ala --- --- Ala Cys Thr Gly Cys    (SEQ ID NO: 672)
Pro Gly Thr Cys --- Glu --- Cys Ala --- Ala --- Cys Thr Gly Cys    (SEQ ID NO: 673)
Pro Gly Thr Cys --- Glu --- Cys Ala --- Ala Ala Cys --- Gly Cys    (SEQ ID NO: 674)
Pro Gly Thr Cys --- Glu --- Cys Ala --- Ala Ala Cys Thr --- Cys    (SEQ ID NO: 675)
Pro Gly Thr Cys --- Glu --- Cys Ala Tyr --- Ala Cys Thr Gly Cys    (SEQ ID NO: 676)
Pro Gly Thr Cys --- Glu --- Cys Ala Tyr --- --- Cys Thr Gly Cys    (SEQ ID NO: 677)
Pro Gly Thr Cys --- Glu --- Cys Ala Tyr --- Ala Cys --- Gly Cys    (SEQ ID NO: 678)
Pro Gly Thr Cys --- Glu --- Cys Ala Tyr --- Ala Cys Thr --- Cys    (SEQ ID NO: 679)
Pro Gly Thr Cys --- Glu --- Cys Ala Tyr Ala --- Cys Thr Gly Cys    (SEQ ID NO: 680)
Pro Gly Thr Cys --- Glu --- Cys Ala Tyr Ala --- Cys --- Gly Cys    (SEQ ID NO: 681)
Pro Gly Thr Cys --- Glu --- Cys Ala Tyr Ala --- Cys Thr --- Cys    (SEQ ID NO: 682)
Pro Gly Thr Cys --- Glu --- Cys Ala Tyr Ala Ala Cys --- Gly Cys    (SEQ ID NO: 683)
Pro Gly Thr Cys --- Glu --- Cys Ala Tyr Ala Ala Cys --- --- Cys    (SEQ ID NO: 684)
Pro Gly Thr Cys --- Glu --- Cys Ala Tyr Ala Ala Cys Thr --- Cys    (SEQ ID NO: 685)
Pro Gly Thr Cys --- Glu Ile Cys --- Tyr Ala Ala Cys Thr Gly Cys    (SEQ ID NO: 686)
Pro Gly Thr Cys --- Glu Ile Cys --- --- Ala Ala Cys Thr Gly Cys    (SEQ ID NO: 687)
Pro Gly Thr Cys --- Glu Ile Cys --- --- --- Ala Cys Thr Gly Cys    (SEQ ID NO: 688)
Pro Gly Thr Cys --- Glu Ile Cys --- --- Ala --- Cys Thr Gly Cys    (SEQ ID NO: 689)
Pro Gly Thr Cys --- Glu Ile Cys --- --- Ala Ala Cys --- Gly Cys    (SEQ ID NO: 690)
Pro Gly Thr Cys --- Glu Ile Cys --- --- Ala Ala Cys Thr --- Cys    (SEQ ID NO: 691)
Pro Gly Thr Cys --- Glu Ile Cys --- Tyr --- Ala Cys Thr Gly Cys    (SEQ ID NO: 692)
Pro Gly Thr Cys --- Glu Ile Cys --- Tyr --- --- Cys Thr Gly Cys    (SEQ ID NO: 693)
Pro Gly Thr Cys --- Glu Ile Cys --- Tyr --- Ala Cys --- Gly Cys    (SEQ ID NO: 694)
Pro Gly Thr Cys --- Glu Ile Cys --- Tyr --- Ala Cys Thr --- Cys    (SEQ ID NO: 695)
Pro Gly Thr Cys --- Glu Ile Cys --- Tyr Ala --- Cys Thr Gly Cys    (SEQ ID NO: 696)
Pro Gly Thr Cys --- Glu Ile Cys --- Tyr Ala --- Cys --- Gly Cys    (SEQ ID NO: 697)
Pro Gly Thr Cys --- Glu Ile Cys --- Tyr Ala --- Cys Thr --- Cys    (SEQ ID NO: 698)
Pro Gly Thr Cys --- Glu Ile Cys --- Tyr Ala Ala Cys --- Gly Cys    (SEQ ID NO: 699)
Pro Gly Thr Cys --- Glu Ile Cys --- Tyr Ala Ala Cys --- --- Cys    (SEQ ID NO: 700)
Pro Gly Thr Cys --- Glu Ile Cys --- Tyr Ala Ala Cys Thr --- Cys    (SEQ ID NO: 701)
Pro Gly Thr Cys --- Glu Ile Cys Ala --- Ala Ala Cys Thr Gly Cys    (SEQ ID NO: 702)
Pro Gly Thr Cys --- Glu Ile Cys Ala --- --- Ala Cys Thr Gly Cys    (SEQ ID NO: 703)
```

FIG. 1

```
Pro Gly Thr Cys --- Glu Ile Cys Ala --- --- --- Cys Thr Gly Cys   (SEQ ID NO: 704)
Pro Gly Thr Cys --- Glu Ile Cys Ala --- --- Ala Cys --- Gly Cys   (SEQ ID NO: 705)
Pro Gly Thr Cys --- Glu Ile Cys Ala --- --- Ala Cys Thr --- Cys   (SEQ ID NO: 706)
Pro Gly Thr Cys --- Glu Ile Cys Ala --- Ala --- Cys Thr Gly Cys   (SEQ ID NO: 707)
Pro Gly Thr Cys --- Glu Ile Cys Ala --- Ala --- Cys --- Gly Cys   (SEQ ID NO: 708)
Pro Gly Thr Cys --- Glu Ile Cys Ala --- Ala --- Cys Thr --- Cys   (SEQ ID NO: 709)
Pro Gly Thr Cys --- Glu Ile Cys Ala --- Ala Ala Cys --- Gly Cys   (SEQ ID NO: 710)
Pro Gly Thr Cys --- Glu Ile Cys Ala --- Ala Ala Cys --- --- Cys   (SEQ ID NO: 711)
Pro Gly Thr Cys --- Glu Ile Cys Ala --- Ala Ala Cys Thr --- Cys   (SEQ ID NO: 712)
Pro Gly Thr Cys --- Glu Ile Cys Ala Tyr --- Ala Cys Thr Gly Cys   (SEQ ID NO: 713)
Pro Gly Thr Cys --- Glu Ile Cys Ala Tyr --- --- Cys Thr Gly Cys   (SEQ ID NO: 714)
Pro Gly Thr Cys --- Glu Ile Cys Ala Tyr --- --- Cys --- Gly Cys   (SEQ ID NO: 715)
Pro Gly Thr Cys --- Glu Ile Cys Ala Tyr --- --- Cys Thr --- Cys   (SEQ ID NO: 716)
Pro Gly Thr Cys --- Glu Ile Cys Ala Tyr --- Ala Cys --- Gly Cys   (SEQ ID NO: 717)
Pro Gly Thr Cys --- Glu Ile Cys Ala Tyr --- Ala Cys --- --- Cys   (SEQ ID NO: 718)
Pro Gly Thr Cys --- Glu Ile Cys Ala Tyr --- Ala Cys Thr --- Cys   (SEQ ID NO: 719)
Pro Gly Thr Cys --- Glu Ile Cys Ala Tyr Ala --- Cys Thr Gly Cys   (SEQ ID NO: 720)
Pro Gly Thr Cys --- Glu Ile Cys Ala Tyr Ala --- Cys --- Gly Cys   (SEQ ID NO: 721)
Pro Gly Thr Cys --- Glu Ile Cys Ala Tyr Ala --- Cys --- --- Cys   (SEQ ID NO: 722)
Pro Gly Thr Cys --- Glu Ile Cys Ala Tyr Ala --- Cys Thr --- Cys   (SEQ ID NO: 723)
Pro Gly Thr Cys --- Glu Ile Cys Ala Tyr Ala Ala Cys --- Gly Cys   (SEQ ID NO: 724)
Pro Gly Thr Cys --- Glu Ile Cys Ala Tyr Ala Ala Cys --- --- Cys   (SEQ ID NO: 725)
Pro Gly Thr Cys --- Glu Ile Cys Ala Tyr Ala Ala Cys Thr --- Cys   (SEQ ID NO: 726)
Pro Gly Thr Cys Gly --- Ile Cys Ala Tyr Ala Ala Cys Thr Gly Cys   (SEQ ID NO: 727)
Pro Gly Thr Cys Gly --- --- Cys Ala Tyr Ala Ala Cys Thr Gly Cys   (SEQ ID NO: 728)
Pro Gly Thr Cys Gly --- --- Cys --- Tyr Ala Ala Cys Thr Gly Cys   (SEQ ID NO: 729)
Pro Gly Thr Cys Gly --- --- Cys --- --- Ala Ala Cys Thr Gly Cys   (SEQ ID NO: 730)
Pro Gly Thr Cys Gly --- --- Cys --- Tyr --- Ala Cys Thr Gly Cys   (SEQ ID NO: 731)
Pro Gly Thr Cys Gly --- --- Cys --- Tyr Ala --- Cys Thr Gly Cys   (SEQ ID NO: 732)
Pro Gly Thr Cys Gly --- --- Cys --- Tyr Ala Ala Cys --- Gly Cys   (SEQ ID NO: 733)
Pro Gly Thr Cys Gly --- --- Cys --- Tyr Ala Ala Cys Thr --- Cys   (SEQ ID NO: 734)
Pro Gly Thr Cys Gly --- --- Cys Ala --- Ala Ala Cys Thr Gly Cys   (SEQ ID NO: 735)
Pro Gly Thr Cys Gly --- --- Cys Ala --- --- Ala Cys Thr Gly Cys   (SEQ ID NO: 736)
Pro Gly Thr Cys Gly --- --- Cys Ala --- Ala --- Cys Thr Gly Cys   (SEQ ID NO: 737)
Pro Gly Thr Cys Gly --- --- Cys Ala --- Ala Ala Cys --- Gly Cys   (SEQ ID NO: 738)
Pro Gly Thr Cys Gly --- --- Cys Ala --- Ala Ala Cys Thr --- Cys   (SEQ ID NO: 739)
Pro Gly Thr Cys Gly --- --- Cys Ala Tyr --- Ala Cys Thr Gly Cys   (SEQ ID NO: 740)
Pro Gly Thr Cys Gly --- --- Cys Ala Tyr --- --- Cys Thr Gly Cys   (SEQ ID NO: 741)
Pro Gly Thr Cys Gly --- --- Cys Ala Tyr --- Ala Cys --- Gly Cys   (SEQ ID NO: 742)
Pro Gly Thr Cys Gly --- --- Cys Ala Tyr --- Ala Cys Thr --- Cys   (SEQ ID NO: 743)
Pro Gly Thr Cys Gly --- --- Cys Ala Tyr Ala --- Cys Thr Gly Cys   (SEQ ID NO: 744)
Pro Gly Thr Cys Gly --- --- Cys Ala Tyr Ala --- Cys --- Gly Cys   (SEQ ID NO: 745)
Pro Gly Thr Cys Gly --- --- Cys Ala Tyr Ala --- Cys Thr --- Cys   (SEQ ID NO: 746)
Pro Gly Thr Cys Gly --- --- Cys Ala Tyr Ala Ala Cys --- Gly Cys   (SEQ ID NO: 747)
Pro Gly Thr Cys Gly --- --- Cys Ala Tyr Ala Ala Cys --- --- Cys   (SEQ ID NO: 748)
Pro Gly Thr Cys Gly --- --- Cys Ala Tyr Ala Ala Cys Thr --- Cys   (SEQ ID NO: 749)
Pro Gly Thr Cys Gly --- Ile Cys --- Tyr Ala Ala Cys Thr Gly Cys   (SEQ ID NO: 750)
```

FIG. 1

```
Pro Gly Thr Cys Gly --- Ile Cys --- --- Ala Ala Cys Thr Gly Cys  (SEQ ID NO: 751)
Pro Gly Thr Cys Gly --- Ile Cys --- --- --- Ala Cys Thr Gly Cys  (SEQ ID NO: 752)
Pro Gly Thr Cys Gly --- Ile Cys --- --- Ala --- Cys Thr Gly Cys  (SEQ ID NO: 753)
Pro Gly Thr Cys Gly --- Ile Cys --- --- Ala Ala Cys --- Gly Cys  (SEQ ID NO: 754)
Pro Gly Thr Cys Gly --- Ile Cys --- --- Ala Ala Cys Thr --- Cys  (SEQ ID NO: 755)
Pro Gly Thr Cys Gly --- Ile Cys --- Tyr --- Ala Cys Thr Gly Cys  (SEQ ID NO: 756)
Pro Gly Thr Cys Gly --- Ile Cys --- Tyr --- --- Cys Thr Gly Cys  (SEQ ID NO: 757)
Pro Gly Thr Cys Gly --- Ile Cys --- Tyr --- Ala Cys --- Gly Cys  (SEQ ID NO: 758)
Pro Gly Thr Cys Gly --- Ile Cys --- Tyr --- Ala Cys Thr --- Cys  (SEQ ID NO: 759)
Pro Gly Thr Cys Gly --- Ile Cys --- Tyr Ala --- Cys Thr Gly Cys  (SEQ ID NO: 760)
Pro Gly Thr Cys Gly --- Ile Cys --- Tyr Ala --- Cys --- Gly Cys  (SEQ ID NO: 761)
Pro Gly Thr Cys Gly --- Ile Cys --- Tyr Ala --- Cys Thr --- Cys  (SEQ ID NO: 762)
Pro Gly Thr Cys Gly --- Ile Cys --- Tyr Ala Ala Cys --- Gly Cys  (SEQ ID NO: 763)
Pro Gly Thr Cys Gly --- Ile Cys --- Tyr Ala Ala Cys --- --- Cys  (SEQ ID NO: 764)
Pro Gly Thr Cys Gly --- Ile Cys --- Tyr Ala Ala Cys Thr --- Cys  (SEQ ID NO: 765)
Pro Gly Thr Cys Gly --- Ile Cys Ala --- Ala Ala Cys Thr Gly Cys  (SEQ ID NO: 766)
Pro Gly Thr Cys Gly --- Ile Cys Ala --- --- Ala Cys Thr Gly Cys  (SEQ ID NO: 767)
Pro Gly Thr Cys Gly --- Ile Cys Ala --- --- --- Cys Thr Gly Cys  (SEQ ID NO: 768)
Pro Gly Thr Cys Gly --- Ile Cys Ala --- --- Ala Cys --- Gly Cys  (SEQ ID NO: 769)
Pro Gly Thr Cys Gly --- Ile Cys Ala --- --- Ala Cys Thr --- Cys  (SEQ ID NO: 770)
Pro Gly Thr Cys Gly --- Ile Cys Ala --- Ala --- Cys Thr Gly Cys  (SEQ ID NO: 771)
Pro Gly Thr Cys Gly --- Ile Cys Ala --- Ala --- Cys --- Gly Cys  (SEQ ID NO: 772)
Pro Gly Thr Cys Gly --- Ile Cys Ala --- Ala --- Cys Thr --- Cys  (SEQ ID NO: 773)
Pro Gly Thr Cys Gly --- Ile Cys Ala --- Ala Ala Cys --- Gly Cys  (SEQ ID NO: 774)
Pro Gly Thr Cys Gly --- Ile Cys Ala --- Ala Ala Cys --- --- Cys  (SEQ ID NO: 775)
Pro Gly Thr Cys Gly --- Ile Cys Ala --- Ala Ala Cys Thr --- Cys  (SEQ ID NO: 776)
Pro Gly Thr Cys Gly --- Ile Cys Ala Tyr --- Ala Cys Thr Gly Cys  (SEQ ID NO: 777)
Pro Gly Thr Cys Gly --- Ile Cys Ala Tyr --- --- Cys Thr Gly Cys  (SEQ ID NO: 778)
Pro Gly Thr Cys Gly --- Ile Cys Ala Tyr --- --- Cys --- Gly Cys  (SEQ ID NO: 779)
Pro Gly Thr Cys Gly --- Ile Cys Ala Tyr --- --- Cys Thr --- Cys  (SEQ ID NO: 780)
Pro Gly Thr Cys Gly --- Ile Cys Ala Tyr --- Ala Cys --- Gly Cys  (SEQ ID NO: 781)
Pro Gly Thr Cys Gly --- Ile Cys Ala Tyr --- Ala Cys --- --- Cys  (SEQ ID NO: 782)
Pro Gly Thr Cys Gly --- Ile Cys Ala Tyr --- Ala Cys Thr --- Cys  (SEQ ID NO: 783)
Pro Gly Thr Cys Gly --- Ile Cys Ala Tyr Ala --- Cys Thr Gly Cys  (SEQ ID NO: 784)
Pro Gly Thr Cys Gly --- Ile Cys Ala Tyr Ala --- Cys --- Gly Cys  (SEQ ID NO: 785)
Pro Gly Thr Cys Gly --- Ile Cys Ala Tyr Ala --- Cys --- --- Cys  (SEQ ID NO: 786)
Pro Gly Thr Cys Gly --- Ile Cys Ala Tyr Ala --- Cys Thr --- Cys  (SEQ ID NO: 787)
Pro Gly Thr Cys Gly --- Ile Cys Ala Tyr Ala Ala Cys --- Gly Cys  (SEQ ID NO: 788)
Pro Gly Thr Cys Gly --- Ile Cys Ala Tyr Ala Ala Cys --- --- Cys  (SEQ ID NO: 789)
Pro Gly Thr Cys Gly --- Ile Cys Ala Tyr Ala Ala Cys Thr --- Cys  (SEQ ID NO: 790)
Pro Gly Thr Cys Gly Glu --- Cys Ala Tyr Ala Ala Cys Thr Gly Cys  (SEQ ID NO: 791)
Pro Gly Thr Cys Gly Glu --- Cys --- Tyr Ala Ala Cys Thr Gly Cys  (SEQ ID NO: 792)
Pro Gly Thr Cys Gly Glu --- Cys --- --- Ala Ala Cys Thr Gly Cys  (SEQ ID NO: 793)
Pro Gly Thr Cys Gly Glu --- Cys --- --- --- Ala Cys Thr Gly Cys  (SEQ ID NO: 794)
Pro Gly Thr Cys Gly Glu --- Cys --- --- Ala --- Cys Thr Gly Cys  (SEQ ID NO: 795)
Pro Gly Thr Cys Gly Glu --- Cys --- --- Ala Ala Cys --- Gly Cys  (SEQ ID NO: 796)
Pro Gly Thr Cys Gly Glu --- Cys --- --- Ala Ala Cys Thr --- Cys  (SEQ ID NO: 797)
```

FIG. 1

```
Pro Gly Thr Cys Gly Glu --- Cys --- Tyr --- Ala Cys Thr Gly Cys    (SEQ ID NO: 798)
Pro Gly Thr Cys Gly Glu --- Cys --- Tyr --- --- Cys Thr Gly Cys    (SEQ ID NO: 799)
Pro Gly Thr Cys Gly Glu --- Cys --- Tyr --- Ala Cys --- Gly Cys    (SEQ ID NO: 800)
Pro Gly Thr Cys Gly Glu --- Cys --- Tyr --- Ala Cys Thr --- Cys    (SEQ ID NO: 801)
Pro Gly Thr Cys Gly Glu --- Cys --- Tyr Ala --- Cys Thr Gly Cys    (SEQ ID NO: 802)
Pro Gly Thr Cys Gly Glu --- Cys --- Tyr Ala --- Cys --- Gly Cys    (SEQ ID NO: 803)
Pro Gly Thr Cys Gly Glu --- Cys --- Tyr Ala --- Cys Thr --- Cys    (SEQ ID NO: 804)
Pro Gly Thr Cys Gly Glu --- Cys --- Tyr Ala Ala Cys --- Gly Cys    (SEQ ID NO: 805)
Pro Gly Thr Cys Gly Glu --- Cys --- Tyr Ala Ala Cys --- --- Cys    (SEQ ID NO: 806)
Pro Gly Thr Cys Gly Glu --- Cys --- Tyr Ala Ala Cys Thr --- Cys    (SEQ ID NO: 807)
Pro Gly Thr Cys Gly Glu --- Cys Ala --- Ala Ala Cys Thr Gly Cys    (SEQ ID NO: 808)
Pro Gly Thr Cys Gly Glu --- Cys Ala --- --- Ala Cys Thr Gly Cys    (SEQ ID NO: 809)
Pro Gly Thr Cys Gly Glu --- Cys Ala --- --- --- Cys Thr Gly Cys    (SEQ ID NO: 810)
Pro Gly Thr Cys Gly Glu --- Cys Ala --- --- Ala Cys --- Gly Cys    (SEQ ID NO: 811)
Pro Gly Thr Cys Gly Glu --- Cys Ala --- --- Ala Cys Thr --- Cys    (SEQ ID NO: 812)
Pro Gly Thr Cys Gly Glu --- Cys Ala --- Ala --- Cys Thr Gly Cys    (SEQ ID NO: 813)
Pro Gly Thr Cys Gly Glu --- Cys Ala --- Ala --- Cys --- Gly Cys    (SEQ ID NO: 814)
Pro Gly Thr Cys Gly Glu --- Cys Ala --- Ala --- Cys Thr --- Cys    (SEQ ID NO: 815)
Pro Gly Thr Cys Gly Glu --- Cys Ala --- Ala Ala Cys --- Gly Cys    (SEQ ID NO: 816)
Pro Gly Thr Cys Gly Glu --- Cys Ala --- Ala Ala Cys --- --- Cys    (SEQ ID NO: 817)
Pro Gly Thr Cys Gly Glu --- Cys Ala --- Ala Ala Cys Thr --- Cys    (SEQ ID NO: 818)
Pro Gly Thr Cys Gly Glu --- Cys Ala Tyr --- Ala Cys Thr Gly Cys    (SEQ ID NO: 819)
Pro Gly Thr Cys Gly Glu --- Cys Ala Tyr --- --- Cys Thr Gly Cys    (SEQ ID NO: 820)
Pro Gly Thr Cys Gly Glu --- Cys Ala Tyr --- --- Cys --- Gly Cys    (SEQ ID NO: 821)
Pro Gly Thr Cys Gly Glu --- Cys Ala Tyr --- --- Cys Thr --- Cys    (SEQ ID NO: 822)
Pro Gly Thr Cys Gly Glu --- Cys Ala Tyr --- Ala Cys --- Gly Cys    (SEQ ID NO: 823)
Pro Gly Thr Cys Gly Glu --- Cys Ala Tyr --- Ala Cys --- --- Cys    (SEQ ID NO: 824)
Pro Gly Thr Cys Gly Glu --- Cys Ala Tyr --- Ala Cys Thr --- Cys    (SEQ ID NO: 825)
Pro Gly Thr Cys Gly Glu --- Cys Ala Tyr Ala --- Cys Thr Gly Cys    (SEQ ID NO: 826)
Pro Gly Thr Cys Gly Glu --- Cys Ala Tyr Ala --- Cys --- Gly Cys    (SEQ ID NO: 827)
Pro Gly Thr Cys Gly Glu --- Cys Ala Tyr Ala --- Cys --- --- Cys    (SEQ ID NO: 828)
Pro Gly Thr Cys Gly Glu --- Cys Ala Tyr Ala --- Cys Thr --- Cys    (SEQ ID NO: 829)
Pro Gly Thr Cys Gly Glu --- Cys Ala Tyr Ala Ala Cys --- Gly Cys    (SEQ ID NO: 830)
Pro Gly Thr Cys Gly Glu --- Cys Ala Tyr Ala Ala Cys --- --- Cys    (SEQ ID NO: 831)
Pro Gly Thr Cys Gly Glu --- Cys Ala Tyr Ala Ala Cys Thr --- Cys    (SEQ ID NO: 832)
Pro Gly Thr Cys Gly Glu Ile Cys --- Tyr Ala Ala Cys Thr Gly Cys    (SEQ ID NO: 833)
Pro Gly Thr Cys Gly Glu Ile Cys --- --- Ala Ala Cys Thr Gly Cys    (SEQ ID NO: 834)
Pro Gly Thr Cys Gly Glu Ile Cys --- --- --- Ala Cys Thr Gly Cys    (SEQ ID NO: 835)
Pro Gly Thr Cys Gly Glu Ile Cys --- --- --- --- Cys Thr Gly Cys    (SEQ ID NO: 836)
Pro Gly Thr Cys Gly Glu Ile Cys --- --- --- Ala Cys --- Gly Cys    (SEQ ID NO: 837)
Pro Gly Thr Cys Gly Glu Ile Cys --- --- --- Ala Cys Thr --- Cys    (SEQ ID NO: 838)
Pro Gly Thr Cys Gly Glu Ile Cys --- --- Ala --- Cys Thr Gly Cys    (SEQ ID NO: 839)
Pro Gly Thr Cys Gly Glu Ile Cys --- --- Ala --- Cys --- Gly Cys    (SEQ ID NO: 840)
Pro Gly Thr Cys Gly Glu Ile Cys --- --- Ala --- Cys Thr --- Cys    (SEQ ID NO: 841)
Pro Gly Thr Cys Gly Glu Ile Cys --- --- Ala Ala Cys --- Gly Cys    (SEQ ID NO: 842)
Pro Gly Thr Cys Gly Glu Ile Cys --- --- Ala Ala Cys --- --- Cys    (SEQ ID NO: 843)
Pro Gly Thr Cys Gly Glu Ile Cys --- --- Ala Ala Cys Thr --- Cys    (SEQ ID NO: 844)
```

FIG. 1

Pro Gly Thr Cys Gly Glu Ile Cys --- Tyr --- Ala Cys Thr Gly Cys (SEQ ID NO: 845)
Pro Gly Thr Cys Gly Glu Ile Cys --- Tyr --- --- Cys Thr Gly Cys (SEQ ID NO: 846)
Pro Gly Thr Cys Gly Glu Ile Cys --- Tyr --- --- Cys --- Gly Cys (SEQ ID NO: 847)
Pro Gly Thr Cys Gly Glu Ile Cys --- Tyr --- --- Cys Thr --- Cys (SEQ ID NO: 848)
Pro Gly Thr Cys Gly Glu Ile Cys --- Tyr --- Ala Cys --- Gly Cys (SEQ ID NO: 849)
Pro Gly Thr Cys Gly Glu Ile Cys --- Tyr --- Ala Cys --- --- Cys (SEQ ID NO: 850)
Pro Gly Thr Cys Gly Glu Ile Cys --- Tyr --- Ala Cys Thr --- Cys (SEQ ID NO: 851)
Pro Gly Thr Cys Gly Glu Ile Cys --- Tyr Ala --- Cys Thr Gly Cys (SEQ ID NO: 852)
Pro Gly Thr Cys Gly Glu Ile Cys --- Tyr Ala --- Cys --- Gly Cys (SEQ ID NO: 853)
Pro Gly Thr Cys Gly Glu Ile Cys --- Tyr Ala --- Cys --- --- Cys (SEQ ID NO: 854)
Pro Gly Thr Cys Gly Glu Ile Cys --- Tyr Ala --- Cys Thr --- Cys (SEQ ID NO: 855)
Pro Gly Thr Cys Gly Glu Ile Cys --- Tyr Ala Ala Cys --- Gly Cys (SEQ ID NO: 856)
Pro Gly Thr Cys Gly Glu Ile Cys --- Tyr Ala Ala Cys --- --- Cys (SEQ ID NO: 857)
Pro Gly Thr Cys Gly Glu Ile Cys --- Tyr Ala Ala Cys Thr --- Cys (SEQ ID NO: 858)
Pro Gly Thr Cys Gly Glu Ile Cys Ala --- Ala Ala Cys Thr Gly Cys (SEQ ID NO: 859)
Pro Gly Thr Cys Gly Glu Ile Cys Ala --- --- Ala Cys Thr Gly Cys (SEQ ID NO: 860)
Pro Gly Thr Cys Gly Glu Ile Cys Ala --- --- --- Cys Thr Gly Cys (SEQ ID NO: 861)
Pro Gly Thr Cys Gly Glu Ile Cys Ala --- --- --- Cys --- Gly Cys (SEQ ID NO: 862)
Pro Gly Thr Cys Gly Glu Ile Cys Ala --- --- --- Cys Thr --- Cys (SEQ ID NO: 863)
Pro Gly Thr Cys Gly Glu Ile Cys Ala --- --- Ala Cys --- Gly Cys (SEQ ID NO: 864)
Pro Gly Thr Cys Gly Glu Ile Cys Ala --- --- Ala Cys --- --- Cys (SEQ ID NO: 865)
Pro Gly Thr Cys Gly Glu Ile Cys Ala --- --- Ala Cys Thr --- Cys (SEQ ID NO: 866)
Pro Gly Thr Cys Gly Glu Ile Cys Ala --- Ala --- Cys Thr Gly Cys (SEQ ID NO: 867)
Pro Gly Thr Cys Gly Glu Ile Cys Ala --- Ala --- Cys --- Gly Cys (SEQ ID NO: 868)
Pro Gly Thr Cys Gly Glu Ile Cys Ala --- Ala --- Cys --- --- Cys (SEQ ID NO: 869)
Pro Gly Thr Cys Gly Glu Ile Cys Ala --- Ala --- Cys Thr --- Cys (SEQ ID NO: 870)
Pro Gly Thr Cys Gly Glu Ile Cys Ala --- Ala Ala Cys --- Gly Cys (SEQ ID NO: 871)
Pro Gly Thr Cys Gly Glu Ile Cys Ala --- Ala Ala Cys --- --- Cys (SEQ ID NO: 872)
Pro Gly Thr Cys Gly Glu Ile Cys Ala --- Ala Ala Cys Thr --- Cys (SEQ ID NO: 873)
Pro Gly Thr Cys Gly Glu Ile Cys Ala Tyr --- Ala Cys Thr Gly Cys (SEQ ID NO: 874)
Pro Gly Thr Cys Gly Glu Ile Cys Ala Tyr --- --- Cys Thr Gly Cys (SEQ ID NO: 875)
Pro Gly Thr Cys Gly Glu Ile Cys Ala Tyr --- --- Cys --- Gly Cys (SEQ ID NO: 876)
Pro Gly Thr Cys Gly Glu Ile Cys Ala Tyr --- --- Cys --- --- Cys (SEQ ID NO: 877)
Pro Gly Thr Cys Gly Glu Ile Cys Ala Tyr --- --- Cys Thr --- Cys (SEQ ID NO: 878)
Pro Gly Thr Cys Gly Glu Ile Cys Ala Tyr --- Ala Cys --- Gly Cys (SEQ ID NO: 879)
Pro Gly Thr Cys Gly Glu Ile Cys Ala Tyr --- Ala Cys --- --- Cys (SEQ ID NO: 880)
Pro Gly Thr Cys Gly Glu Ile Cys Ala Tyr --- Ala Cys Thr --- Cys (SEQ ID NO: 881)
Pro Gly Thr Cys Gly Glu Ile Cys Ala Tyr Ala --- Cys Thr Gly Cys (SEQ ID NO: 882)
Pro Gly Thr Cys Gly Glu Ile Cys Ala Tyr Ala --- Cys --- Gly Cys (SEQ ID NO: 883)
Pro Gly Thr Cys Gly Glu Ile Cys Ala Tyr Ala --- Cys --- --- Cys (SEQ ID NO: 884)
Pro Gly Thr Cys Gly Glu Ile Cys Ala Tyr Ala --- Cys Thr --- Cys (SEQ ID NO: 885)
Pro Gly Thr Cys Gly Glu Ile Cys Ala Tyr Ala Ala Cys --- Gly Cys (SEQ ID NO: 886)
Pro Gly Thr Cys Gly Glu Ile Cys Ala Tyr Ala Ala Cys --- --- Cys (SEQ ID NO: 887)
Pro Gly Thr Cys Gly Glu Ile Cys Ala Tyr Ala Ala Cys Thr --- Cys (SEQ ID NO: 888)

FIG. 1

| | |
|---|---|
| Pro Gly Xaa' Thr Cys Gly Glu Ile Cys Ala Tyr Ala Ala Cys Thr Gly Cys | (SEQ IDNO: 889) |
| Pro Gly Xaa' Xaa' Cys Gly Glu Ile Cys Ala Tyr Ala Ala Cys Thr Gly Cys | (SEQ ID NO: 890) |
| Pro Gly Xaa' Xaa' Xaa' Gly Glu Ile Cys Ala Tyr Ala Ala Cys Thr Gly Cys | (SEQ ID NO: 891) |
| Pro Gly Xaa' Xaa' Xaa' Xaa' Glu Ile Cys Ala Tyr Ala Ala Cys Thr Gly Cys | (SEQ ID NO: 892) |
| Pro Gly Xaa' Xaa' Xaa' Xaa' Xaa' Ile Cys Ala Tyr Ala Ala Cys Thr Gly Cys | (SEQ ID NO: 893) |
| Pro Gly Xaa' Xaa' Xaa' Xaa' Xaa' Xaa' Cys Ala Tyr Ala Ala Cys Thr Gly Cys | (SEQ ID NO: 894) |
| Pro Gly Xaa' Xaa' Xaa' Xaa' Xaa' Xaa' Xaa' Ala Tyr Ala Ala Cys Thr Gly Cys | (SEQ ID NO: 895) |
| Pro Gly Xaa' Xaa' Xaa' Xaa' Xaa' Xaa' Xaa' Xaa' Tyr Ala Ala Cys Thr Gly Cys | (SEQ ID NO: 896) |
| Pro Gly Xaa' Xaa' Xaa' Xaa' Xaa' Xaa' Xaa' Xaa' Xaa' Ala Ala Cys Thr Gly Cys | (SEQ ID NO: 897) |
| Pro Gly Xaa' Xaa' Xaa' Xaa' Xaa' Xaa' Xaa' Xaa' Xaa' Xaa' Ala Cys Thr Gly Cys | (SEQ ID NO: 898) |
| Pro Gly Xaa' Xaa' Xaa' Xaa' Xaa' Xaa' Xaa' Xaa' Xaa' Xaa' Xaa' Cys Thr Gly Cys | (SEQ ID NO: 899) |
| Pro Gly Xaa' Xaa' Xaa' Xaa' Xaa' Xaa' Xaa' Xaa' Xaa' Xaa' Xaa' Xaa' Thr Gly Cys | (SEQ ID NO: 900) |
| Pro Gly Xaa' Xaa' Xaa' Xaa' Xaa' Xaa' Xaa' Xaa' Xaa' Xaa' Xaa' Xaa' Xaa' Gly Cys | (SEQ ID NO: 901) |
| Pro Gly Xaa' Xaa' Xaa' Xaa' Xaa' Xaa' Xaa' Xaa' Xaa' Xaa' Xaa' Xaa' Xaa' Xaa' Cys | (SEQ ID NO: 902) |
| Pro Gly Xaa' Xaa' Xaa' Xaa' Xaa' Xaa' Cys Ala Tyr Ala Ala Cys Thr Gly Cys | (SEQ ID NO: 903) |
| Pro Gly Xaa' Xaa' Xaa' Xaa' Xaa' Ile Cys Ala Tyr Ala Ala Cys Thr Gly Xaa' Cys | (SEQ ID NO: 904) |
| Pro Gly Xaa' Xaa' Xaa' Xaa' Xaa' Ile Cys Ala Tyr Ala Ala Cys Thr Gly Xaa' Cys | (SEQ ID NO: 905) |
| Pro Gly Xaa' Xaa' Xaa' Xaa' Xaa' Ile Cys Ala Tyr Ala Ala Cys Thr Gly Cys Xaa' | (SEQ ID NO: 906) |
| Pro Gly Thr Xaa' Cys Gly Glu Ile Cys Ala Tyr Ala Ala Cys Thr Gly Cys | (SEQ ID NO: 907) |
| Pro Gly Xaa' Thr Xaa' Cys Gly Glu Ile Cys Ala Tyr Ala Ala Cys Thr Gly Cys | (SEQ ID NO: 908) |
| Pro Gly Xaa' Xaa' Cys Gly Xaa' Glu Ile Cys Ala Tyr Ala Ala Cys Thr Gly Cys | (SEQ ID NO: 909) |
| Pro Gly Xaa' Xaa' Cys Gly Xaa' Ile Cys Ala Tyr Ala Ala Cys Thr Gly Cys | (SEQ ID NO: 910) |
| Pro Gly Xaa' Xaa' Cys Gly Glu Xaa' Ile Cys Ala Tyr Ala Ala Cys Thr Gly Cys | (SEQ ID NO: 911) |
| Pro Gly Xaa' Xaa' Cys Gly Glu Xaa' Cys Ala Tyr Ala Ala Cys Thr Gly Cys | (SEQ ID NO: 912) |
| Pro Gly Xaa' Xaa' Cys Gly Glu Ile Xaa' Cys Ala Tyr Ala Ala Cys Thr Gly Cys | (SEQ ID NO: 913) |
| Pro Gly Xaa' Xaa' Cys Gly Glu Ile Cys Xaa' Ala Tyr Ala Ala Cys Thr Gly Cys | (SEQ ID NO: 914) |
| Pro Gly Xaa' Xaa' Cys Gly Glu Ile Cys Ala Xaa' Tyr Ala Ala Cys Thr Gly Cys | (SEQ ID NO: 915) |
| Pro Gly Xaa' Xaa' Cys Gly Glu Ile Cys Ala Xaa' Ala Ala Cys Thr Gly Cys | (SEQ ID NO: 916) |
| Pro Gly Xaa' Xaa' Cys Gly Glu Ile Cys Ala Tyr Xaa' Ala Ala Cys Thr Gly Cys | (SEQ ID NO: 917) |
| Pro Gly Xaa' Xaa' Cys Gly Glu Ile Cys Ala Tyr Ala Xaa' Ala Cys Thr Gly Cys | (SEQ ID NO: 918) |
| Pro Gly Xaa' Xaa' Cys Gly Glu Ile Cys Ala Tyr Ala Ala Xaa' Cys Thr Gly Cys | (SEQ ID NO: 919) |
| Pro Gly Xaa' Xaa' Cys Gly Glu Ile Cys Ala Tyr Ala Ala Cys Xaa' Thr Gly Cys | (SEQ ID NO: 920) |
| Pro Gly Thr Xaa' Cys Gly Glu Ile Cys Ala Tyr Ala Ala Cys Thr Gly Cys Xaa' | (SEQ ID NO: 921) |
| Pro Gly Xaa' Xaa' Cys Gly Glu Ile Cys Ala Tyr Ala Ala Cys Thr Gly Cys | (SEQ ID NO: 922) |

FIG. 2

| | | | | | | | | | | | | | |
|---|---|---|---|---|---|---|---|---|---|---|---|---|---|
| Pro | Gly | Xaa' | Xaa' | Thr | Cys | Xaa' | Xaa' | Gly | Glu | Ile | Cys | Ala | Tyr | Ala | Ala | Cys | Thr | Gly | Cys | (SEQ ID NO: 923) |
| Pro | Gly | Xaa' | Xaa' | Thr | Cys | Xaa' | Xaa' | Gly | Xaa' | Ile | Cys | Ala | Tyr | Ala | Ala | Cys | Thr | Gly | Cys | (SEQ ID NO: 924) |
| Pro | Gly | Xaa' | Xaa' | Thr | Cys | Xaa' | Xaa' | Gly | Glu | Xaa' | Cys | Ala | Tyr | Ala | Ala | Cys | Thr | Gly | Cys | (SEQ ID NO: 925) |
| Pro | Gly | Xaa' | Xaa' | Thr | Cys | Xaa' | Xaa' | Gly | Glu | Ile | Xaa' | Ala | Tyr | Ala | Ala | Cys | Thr | Gly | Cys | (SEQ ID NO: 926) |
| Pro | Gly | Xaa' | Xaa' | Thr | Cys | Xaa' | Xaa' | Gly | Glu | Ile | Cys | Xaa' | Tyr | Ala | Ala | Cys | Thr | Gly | Cys | (SEQ ID NO: 927) |
| Pro | Gly | Xaa' | Xaa' | Thr | Cys | Xaa' | Xaa' | Gly | Glu | Ile | Cys | Ala | Xaa' | Ala | Ala | Cys | Thr | Gly | Cys | (SEQ ID NO: 928) |
| Pro | Gly | Xaa' | Xaa' | Thr | Cys | Xaa' | Xaa' | Gly | Glu | Ile | Cys | Ala | Tyr | Xaa' | Ala | Cys | Thr | Gly | Cys | (SEQ ID NO: 929) |
| Pro | Gly | Xaa' | Xaa' | Thr | Cys | Xaa' | Xaa' | Gly | Glu | Ile | Cys | Ala | Tyr | Ala | Xaa' | Cys | Thr | Gly | Cys | (SEQ ID NO: 930) |
| Pro | Gly | Xaa' | Xaa' | Thr | Cys | Xaa' | Xaa' | Gly | Glu | Ile | Cys | Ala | Tyr | Ala | Ala | Xaa' | Thr | Gly | Cys | (SEQ ID NO: 931) |
| Pro | Gly | Xaa' | Xaa' | Thr | Cys | Xaa' | Xaa' | Gly | Glu | Ile | Cys | Ala | Tyr | Ala | Ala | Cys | Xaa' | Gly | Cys | (SEQ ID NO: 932) |
| Pro | Gly | Xaa' | Xaa' | Thr | Cys | Xaa' | Xaa' | Gly | Glu | Ile | Cys | Ala | Tyr | Ala | Ala | Cys | Thr | Xaa' | Cys | (SEQ ID NO: 933) |
| Pro | Gly | Xaa' | Xaa' | Thr | Cys | Xaa' | Xaa' | Gly | Glu | Ile | Cys | Ala | Tyr | Ala | Ala | Cys | Thr | Gly | Xaa' | (SEQ ID NO: 934) |
| Pro | Gly | Xaa' | Xaa' | Thr | Cys | Xaa' | Gly | Xaa' | Glu | Ile | Cys | Ala | Tyr | Ala | Ala | Cys | Thr | Gly | Cys | (SEQ ID NO: 935) |
| Pro | Gly | Xaa' | Xaa' | Thr | Cys | Gly | Xaa' | Xaa' | Glu | Ile | Cys | Ala | Tyr | Ala | Ala | Cys | Thr | Gly | Cys | (SEQ ID NO: 936) |
| Pro | Gly | Xaa' | Xaa' | Thr | Cys | Xaa' | Xaa' | Gly | Xaa' | Ile | Cys | Ala | Tyr | Ala | Ala | Cys | Thr | Gly | Cys | (SEQ ID NO: 937) |
| Pro | Gly | Xaa' | Xaa' | Thr | Cys | Xaa' | Xaa' | Gly | Xaa' | Xaa' | Cys | Ala | Tyr | Ala | Ala | Cys | Thr | Gly | Cys | (SEQ ID NO: 938) |
| Pro | Gly | Xaa' | Xaa' | Thr | Cys | Xaa' | Xaa' | Gly | Xaa' | Ile | Xaa' | Ala | Tyr | Ala | Ala | Cys | Thr | Gly | Cys | (SEQ ID NO: 939) |
| Pro | Gly | Xaa' | Xaa' | Thr | Cys | Xaa' | Xaa' | Gly | Xaa' | Ile | Cys | Xaa' | Tyr | Ala | Ala | Cys | Thr | Gly | Cys | (SEQ ID NO: 940) |
| Pro | Gly | Xaa' | Xaa' | Thr | Cys | Xaa' | Xaa' | Gly | Xaa' | Ile | Cys | Ala | Xaa' | Ala | Ala | Cys | Thr | Gly | Cys | (SEQ ID NO: 941) |
| Pro | Gly | Xaa' | Xaa' | Thr | Cys | Xaa' | Xaa' | Gly | Xaa' | Ile | Cys | Ala | Tyr | Xaa' | Ala | Cys | Thr | Gly | Cys | (SEQ ID NO: 942) |
| Pro | Gly | Xaa' | Xaa' | Thr | Cys | Xaa' | Xaa' | Gly | Xaa' | Ile | Cys | Ala | Tyr | Ala | Xaa' | Cys | Thr | Gly | Cys | (SEQ ID NO: 943) |
| Pro | Gly | Xaa' | Xaa' | Thr | Cys | Xaa' | Xaa' | Gly | Xaa' | Ile | Cys | Ala | Tyr | Ala | Ala | Xaa' | Thr | Gly | Cys | (SEQ ID NO: 944) |
| Pro | Gly | Xaa' | Xaa' | Thr | Cys | Xaa' | Xaa' | Gly | Xaa' | Ile | Cys | Ala | Tyr | Ala | Ala | Cys | Xaa' | Gly | Cys | (SEQ ID NO: 945) |
| Pro | Gly | Xaa' | Xaa' | Thr | Cys | Xaa' | Xaa' | Gly | Xaa' | Ile | Cys | Ala | Tyr | Ala | Ala | Cys | Thr | Xaa' | Cys | (SEQ ID NO: 946) |
| Pro | Gly | Xaa' | Xaa' | Thr | Cys | Xaa' | Xaa' | Gly | Xaa' | Ile | Cys | Ala | Tyr | Ala | Ala | Cys | Thr | Gly | Xaa' | (SEQ ID NO: 947) |
| Pro | Gly | Xaa' | Xaa' | Thr | Cys | Xaa' | Gly | Xaa' | Xaa' | Ile | Cys | Ala | Tyr | Ala | Ala | Cys | Thr | Gly | Cys | (SEQ ID NO: 948) |
| Pro | Gly | Xaa' | Xaa' | Thr | Cys | Gly | Xaa' | Xaa' | Xaa' | Ile | Cys | Ala | Tyr | Ala | Ala | Cys | Thr | Gly | Cys | (SEQ ID NO: 949) |
| Pro | Gly | Xaa' | Xaa' | Thr | Cys | Xaa' | Xaa' | Gly | Glu | Xaa' | Cys | Ala | Tyr | Ala | Ala | Cys | Thr | Gly | Cys | (SEQ ID NO: 950) |
| Pro | Gly | Xaa' | Xaa' | Thr | Cys | Xaa' | Xaa' | Gly | Glu | Ile | Xaa' | Ala | Tyr | Ala | Ala | Cys | Thr | Gly | Cys | (SEQ ID NO: 951) |
| Pro | Gly | Xaa' | Xaa' | Thr | Cys | Xaa' | Xaa' | Gly | Glu | Ile | Cys | Xaa' | Tyr | Ala | Ala | Cys | Thr | Gly | Cys | (SEQ ID NO: 952) |
| Pro | Gly | Xaa' | Xaa' | Thr | Cys | Xaa' | Xaa' | Gly | Glu | Ile | Cys | Ala | Xaa' | Ala | Ala | Cys | Thr | Gly | Cys | (SEQ ID NO: 953) |
| Pro | Gly | Xaa' | Xaa' | Thr | Cys | Xaa' | Xaa' | Gly | Glu | Ile | Cys | Ala | Tyr | Xaa' | Ala | Cys | Thr | Gly | Cys | (SEQ ID NO: 954) |
| Pro | Gly | Xaa' | Xaa' | Thr | Cys | Xaa' | Xaa' | Gly | Glu | Ile | Cys | Ala | Tyr | Ala | Xaa' | Cys | Thr | Gly | Cys | (SEQ ID NO: 955) |
| Pro | Gly | Xaa' | Xaa' | Thr | Cys | Xaa' | Xaa' | Gly | Glu | Ile | Cys | Ala | Tyr | Ala | Ala | Xaa' | Thr | Gly | Cys | (SEQ ID NO: 956) |

FIG. 2

| | | | | | | | | | | | | |
|---|---|---|---|---|---|---|---|---|---|---|---|---|
| Pro | Gly | Xaa' | Thr | Cys | Gly | Glu | Xaa' | Ile | Cys | Ala | Tyr | Ala | Ala | Cys | Xaa' | Thr | Gly | Cys | (SEQ ID NO: 957) |
| Pro | Gly | Xaa' | Thr | Cys | Gly | Glu | Xaa' | Ile | Cys | Ala | Tyr | Ala | Ala | Cys | Thr | Xaa' | Gly | Cys | (SEQ ID NO: 958) |
| Pro | Gly | Xaa' | Thr | Cys | Gly | Glu | Xaa' | Ile | Cys | Ala | Tyr | Ala | Ala | Cys | Thr | Gly | Xaa' | Cys | (SEQ ID NO: 959) |
| Pro | Gly | Xaa' | Thr | Cys | Gly | Glu | Xaa' | Ile | Cys | Ala | Tyr | Ala | Ala | Cys | Thr | Gly | Cys | Xaa' | (SEQ ID NO: 960) |
| Pro | Gly | Xaa' | Thr | Cys | Gly | Glu | Xaa' | Ile | Cys | Xaa' | Ala | Tyr | Ala | Ala | Cys | Thr | Gly | Cys | (SEQ ID NO: 961) |
| Pro | Gly | Xaa' | Thr | Cys | Gly | Glu | Xaa' | Ile | Cys | Xaa' | Cys | Ala | Tyr | Ala | Ala | Cys | Thr | Gly | Cys | (SEQ ID NO: 962) |
| Pro | Gly | Xaa' | Thr | Cys | Gly | Glu | Xaa' | Ile | Cys | Xaa' | Cys | Xaa' | Ala | Tyr | Ala | Ala | Cys | Thr | Gly | Cys | (SEQ ID NO: 963) |
| Pro | Gly | Xaa' | Thr | Cys | Gly | Glu | Xaa' | Ile | Cys | Xaa' | Cys | Ala | Xaa' | Tyr | Ala | Ala | Cys | Thr | Gly | Cys | (SEQ ID NO: 964) |
| Pro | Gly | Xaa' | Thr | Cys | Gly | Glu | Xaa' | Ile | Cys | Xaa' | Cys | Ala | Tyr | Xaa' | Ala | Ala | Cys | Thr | Gly | Cys | (SEQ ID NO: 965) |
| Pro | Gly | Xaa' | Thr | Cys | Gly | Glu | Xaa' | Ile | Cys | Xaa' | Cys | Ala | Tyr | Ala | Xaa' | Ala | Cys | Thr | Gly | Cys | (SEQ ID NO: 966) |
| Pro | Gly | Xaa' | Thr | Cys | Gly | Glu | Xaa' | Ile | Cys | Xaa' | Cys | Ala | Tyr | Ala | Ala | Xaa' | Cys | Thr | Gly | Cys | (SEQ ID NO: 967) |
| Pro | Gly | Xaa' | Thr | Cys | Gly | Glu | Xaa' | Ile | Cys | Xaa' | Cys | Ala | Tyr | Ala | Ala | Cys | Xaa' | Thr | Gly | Cys | (SEQ ID NO: 968) |
| Pro | Gly | Xaa' | Thr | Cys | Gly | Glu | Xaa' | Ile | Cys | Xaa' | Cys | Ala | Tyr | Ala | Ala | Cys | Thr | Xaa' | Gly | Cys | (SEQ ID NO: 969) |
| Pro | Gly | Xaa' | Thr | Cys | Gly | Glu | Xaa' | Ile | Cys | Xaa' | Cys | Ala | Tyr | Ala | Ala | Cys | Thr | Gly | Xaa' | Cys | (SEQ ID NO: 970) |
| Pro | Gly | Xaa' | Thr | Cys | Gly | Glu | Xaa' | Ile | Cys | Xaa' | Cys | Ala | Tyr | Ala | Ala | Cys | Thr | Gly | Cys | Xaa' | (SEQ ID NO: 971) |
| Pro | Gly | Xaa' | Thr | Cys | Gly | Glu | Xaa' | Ile | Cys | Xaa' | Ala | Xaa' | Tyr | Ala | Ala | Cys | Thr | Gly | Cys | (SEQ ID NO: 972) |
| Pro | Gly | Xaa' | Thr | Cys | Gly | Glu | Xaa' | Ile | Cys | Xaa' | Ala | Tyr | Xaa' | Ala | Ala | Cys | Thr | Gly | Cys | (SEQ ID NO: 973) |
| Pro | Gly | Xaa' | Thr | Cys | Gly | Glu | Xaa' | Ile | Cys | Xaa' | Ala | Tyr | Ala | Xaa' | Ala | Cys | Thr | Gly | Cys | (SEQ ID NO: 974) |
| Pro | Gly | Xaa' | Thr | Cys | Gly | Glu | Xaa' | Ile | Cys | Xaa' | Ala | Tyr | Ala | Ala | Xaa' | Cys | Thr | Gly | Cys | (SEQ ID NO: 975) |
| Pro | Gly | Xaa' | Thr | Cys | Gly | Glu | Xaa' | Ile | Cys | Xaa' | Ala | Tyr | Ala | Ala | Cys | Xaa' | Thr | Gly | Cys | (SEQ ID NO: 976) |
| Pro | Gly | Xaa' | Thr | Cys | Gly | Glu | Xaa' | Ile | Cys | Xaa' | Ala | Tyr | Ala | Ala | Cys | Thr | Xaa' | Gly | Cys | (SEQ ID NO: 977) |
| Pro | Gly | Xaa' | Thr | Cys | Gly | Glu | Xaa' | Ile | Cys | Xaa' | Ala | Tyr | Ala | Ala | Cys | Thr | Gly | Xaa' | Cys | (SEQ ID NO: 978) |
| Pro | Gly | Xaa' | Thr | Cys | Gly | Glu | Xaa' | Ile | Cys | Xaa' | Ala | Tyr | Ala | Ala | Cys | Thr | Gly | Cys | Xaa' | (SEQ ID NO: 979) |
| Pro | Gly | Xaa' | Thr | Cys | Gly | Glu | Xaa' | Ile | Cys | Ala | Xaa' | Tyr | Ala | Ala | Cys | Thr | Gly | Cys | (SEQ ID NO: 980) |
| Pro | Gly | Xaa' | Thr | Cys | Gly | Glu | Xaa' | Ile | Cys | Ala | Xaa' | Tyr | Ala | Ala | Cys | Thr | Gly | Cys | Xaa' | (SEQ ID NO: 981) |
| Pro | Gly | Xaa' | Thr | Cys | Gly | Glu | Xaa' | Ile | Cys | Ala | Xaa' | Xaa' | Tyr | Ala | Ala | Cys | Thr | Gly | Cys | (SEQ ID NO: 982) |
| Pro | Gly | Xaa' | Thr | Cys | Gly | Glu | Xaa' | Ile | Cys | Ala | Xaa' | Tyr | Xaa' | Ala | Ala | Cys | Thr | Gly | Cys | (SEQ ID NO: 983) |
| Pro | Gly | Xaa' | Thr | Cys | Gly | Glu | Xaa' | Ile | Cys | Ala | Xaa' | Tyr | Ala | Xaa' | Ala | Cys | Thr | Gly | Cys | (SEQ ID NO: 984) |
| Pro | Gly | Xaa' | Thr | Cys | Gly | Glu | Xaa' | Ile | Cys | Ala | Xaa' | Tyr | Ala | Ala | Xaa' | Cys | Thr | Gly | Cys | (SEQ ID NO: 985) |
| Pro | Gly | Xaa' | Thr | Cys | Gly | Glu | Xaa' | Ile | Cys | Ala | Xaa' | Tyr | Ala | Ala | Cys | Xaa' | Thr | Gly | Cys | (SEQ ID NO: 986) |
| Pro | Gly | Xaa' | Thr | Cys | Gly | Glu | Xaa' | Ile | Cys | Ala | Xaa' | Tyr | Ala | Ala | Cys | Thr | Xaa' | Gly | Cys | (SEQ ID NO: 987) |
| Pro | Gly | Xaa' | Thr | Cys | Gly | Glu | Xaa' | Ile | Cys | Ala | Xaa' | Tyr | Ala | Ala | Cys | Thr | Xaa' | Gly | Cys | (SEQ ID NO: 988) |
| Pro | Gly | Xaa' | Thr | Cys | Gly | Glu | Xaa' | Ile | Cys | Ala | Xaa' | Tyr | Ala | Ala | Cys | Thr | Gly | Xaa' | Cys | (SEQ ID NO: 989) |
| Pro | Gly | Xaa' | Thr | Cys | Gly | Glu | Xaa' | Ile | Cys | Ala | Xaa' | Tyr | Ala | Ala | Cys | Thr | Gly | Cys | Xaa' | (SEQ ID NO: 990) |

FIG. 2

```
Pro Gly Xaa' Thr Cys Gly Glu Ile Cys Ala Tyr Xaa' Ala Ala Cys Thr Gly Cys    (SEQ ID NO: 991)
Pro Gly Xaa' Thr Cys Gly Glu Ile Cys Ala Tyr Xaa' Xaa' Ala Ala Cys Thr Gly Cys    (SEQ ID NO: 992)
Pro Gly Xaa' Thr Cys Gly Glu Ile Cys Ala Tyr Xaa' Ala Xaa' Ala Cys Thr Gly Cys    (SEQ ID NO: 993)
Pro Gly Xaa' Thr Cys Gly Glu Ile Cys Ala Tyr Xaa' Ala Ala Xaa' Cys Thr Gly Cys    (SEQ ID NO: 994)
Pro Gly Xaa' Thr Cys Gly Glu Ile Cys Ala Tyr Xaa' Ala Ala Ala Cys Xaa' Gly Cys    (SEQ ID NO: 995)
Pro Gly Xaa' Thr Cys Gly Glu Ile Cys Ala Tyr Xaa' Ala Ala Ala Cys Thr Xaa' Gly Cys    (SEQ ID NO: 996)
Pro Gly Xaa' Thr Cys Gly Glu Ile Cys Ala Tyr Xaa' Ala Ala Ala Cys Thr Gly Xaa' Cys    (SEQ ID NO: 997)
Pro Gly Xaa' Thr Cys Gly Glu Ile Cys Ala Tyr Xaa' Ala Ala Ala Cys Thr Gly Cys Xaa'    (SEQ ID NO: 998)
Pro Gly Xaa' Thr Cys Gly Glu Ile Cys Ala Tyr Xaa' Xaa' Ala Xaa' Ala Cys Thr Gly Cys    (SEQ ID NO: 999)
Pro Gly Xaa' Thr Cys Gly Glu Ile Cys Ala Tyr Xaa' Xaa' Ala Xaa' Ala Cys Thr Gly Cys    (SEQ ID NO: 1000)
Pro Gly Xaa' Thr Cys Gly Glu Ile Cys Ala Tyr Xaa' Xaa' Ala Xaa' Cys Thr Gly Cys    (SEQ ID NO: 1001)
Pro Gly Xaa' Thr Cys Gly Glu Ile Cys Ala Tyr Xaa' Xaa' Ala Ala Cys Xaa' Gly Cys    (SEQ ID NO: 1002)
Pro Gly Xaa' Thr Cys Gly Glu Ile Cys Ala Tyr Xaa' Xaa' Ala Ala Cys Thr Xaa' Gly Cys    (SEQ ID NO: 1003)
Pro Gly Xaa' Thr Cys Gly Glu Ile Cys Ala Tyr Xaa' Xaa' Ala Ala Cys Thr Gly Xaa' Cys    (SEQ ID NO: 1004)
Pro Gly Xaa' Thr Cys Gly Glu Ile Cys Ala Tyr Xaa' Xaa' Ala Ala Cys Thr Gly Cys Xaa'    (SEQ ID NO: 1005)
Pro Gly Xaa' Thr Cys Gly Glu Ile Cys Ala Tyr Xaa' Ala Xaa' Xaa' Ala Cys Thr Gly Cys    (SEQ ID NO: 1006)
Pro Gly Xaa' Thr Cys Gly Glu Ile Cys Ala Tyr Xaa' Ala Xaa' Ala Cys Xaa' Thr Gly Cys    (SEQ ID NO: 1007)
Pro Gly Xaa' Thr Cys Gly Glu Ile Cys Ala Tyr Xaa' Ala Xaa' Ala Cys Thr Xaa' Gly Cys    (SEQ ID NO: 1008)
Pro Gly Xaa' Thr Cys Gly Glu Ile Cys Ala Tyr Xaa' Ala Xaa' Ala Cys Thr Gly Xaa' Cys    (SEQ ID NO: 1009)
Pro Gly Xaa' Thr Cys Gly Glu Ile Cys Ala Tyr Xaa' Ala Xaa' Ala Cys Thr Gly Cys Xaa'    (SEQ ID NO: 1010)
Pro Gly Xaa' Thr Cys Gly Glu Ile Cys Ala Tyr Xaa' Ala Ala Xaa' Cys Xaa' Thr Gly Cys    (SEQ ID NO: 1011)
Pro Gly Xaa' Thr Cys Gly Glu Ile Cys Ala Tyr Xaa' Ala Ala Xaa' Cys Thr Xaa' Gly Cys    (SEQ ID NO: 1012)
Pro Gly Xaa' Thr Cys Gly Glu Ile Cys Ala Tyr Xaa' Ala Ala Xaa' Cys Thr Gly Xaa' Cys    (SEQ ID NO: 1013)
Pro Gly Xaa' Thr Cys Gly Glu Ile Cys Ala Tyr Xaa' Ala Ala Xaa' Cys Thr Gly Cys Xaa'    (SEQ ID NO: 1014)
Pro Gly Xaa' Thr Cys Gly Glu Ile Cys Ala Tyr Xaa' Ala Ala Ala Cys Xaa' Thr Gly Cys    (SEQ ID NO: 1015)
Pro Gly Xaa' Thr Cys Gly Glu Ile Cys Ala Tyr Xaa' Ala Ala Ala Cys Xaa' Gly Xaa' Cys    (SEQ ID NO: 1016)
Pro Gly Xaa' Thr Cys Gly Glu Ile Cys Ala Tyr Xaa' Ala Ala Ala Cys Xaa' Gly Cys Xaa'    (SEQ ID NO: 1017)
Pro Gly Xaa' Thr Cys Gly Glu Ile Cys Ala Tyr Xaa' Ala Ala Ala Cys Thr Xaa' Gly Cys    (SEQ ID NO: 1018)
Pro Gly Xaa' Thr Cys Gly Glu Ile Cys Ala Tyr Xaa' Ala Ala Ala Cys Thr Xaa' Gly Xaa' Cys    (SEQ ID NO: 1019)
Pro Gly Xaa' Thr Cys Gly Glu Ile Cys Ala Tyr Xaa' Ala Ala Ala Cys Thr Xaa' Gly Cys Xaa'    (SEQ ID NO: 1020)
Pro Gly Xaa' Thr Cys Gly Glu Ile Cys Ala Tyr Ala Ala Ala Cys Thr Gly Xaa' Cys    (SEQ ID NO: 1021)
Pro Gly Xaa' Thr Cys Gly Glu Ile Cys Ala Tyr Xaa' Ala Ala Ala Cys Thr Gly Xaa' Xaa' Cys    (SEQ ID NO: 1022)
Pro Gly Xaa' Thr Cys Gly Glu Ile Cys Ala Tyr Xaa' Ala Ala Ala Cys Thr Gly Xaa' Cys Xaa'    (SEQ ID NO: 1023)
Pro Gly Xaa' Thr Cys Gly Glu Ile Cys Ala Tyr Ala Ala Ala Cys Thr Gly Cys Xaa'    (SEQ ID NO: 1024)
```

FIG. 2

| | | | | | | | | | | | | | | | | | | | | |
|---|---|---|---|---|---|---|---|---|---|---|---|---|---|---|---|---|---|---|---|---|
| Pro | Gly | Xaa' | Thr | Cys | Gly | Glu | Ile | Cys | Ala | Tyr | Ala | Ala | Cys | Thr | Gly | Cys | Xaa' | Xaa' | | (SEQID NO: 1025) |
| Pro | Gly | Xaa' | Thr | Cys | Xaa' | Gly | Glu | Ile | Cys | Ala | Tyr | Ala | Ala | Cys | Thr | Gly | Cys | | | (SEQID NO: 1026) |
| Pro | Gly | Xaa' | Thr | Cys | Xaa' | Xaa' | Gly | Glu | Ile | Cys | Ala | Tyr | Ala | Ala | Cys | Thr | Gly | Cys | | (SEQID NO: 1027) |
| Pro | Gly | Xaa' | Thr | Cys | Xaa' | Xaa' | Xaa' | Gly | Glu | Ile | Cys | Ala | Tyr | Ala | Ala | Cys | Thr | Gly | Cys | (SEQID NO: 1028) |
| Pro | Gly | Xaa' | Thr | Cys | Xaa' | Xaa' | Xaa' | Gly | Glu | Ile | Cys | Ala | Tyr | Ala | Ala | Cys | Thr | Gly | Cys | (SEQID NO: 1029) |
| Pro | Gly | Xaa' | Thr | Cys | Xaa' | Xaa' | Xaa' | Gly | Glu | Ile | Cys | Ala | Tyr | Ala | Ala | Cys | Thr | Gly | Cys | (SEQID NO: 1030) |
| Pro | Gly | Xaa' | Thr | Cys | Xaa' | Xaa' | Xaa' | Gly | Xaa' | Ile | Cys | Ala | Tyr | Ala | Ala | Cys | Thr | Gly | Cys | (SEQID NO: 1031) |
| Pro | Gly | Xaa' | Thr | Cys | Xaa' | Xaa' | Xaa' | Gly | Glu | Xaa' | Cys | Ala | Tyr | Ala | Ala | Cys | Thr | Gly | Cys | (SEQID NO: 1032) |
| Pro | Gly | Xaa' | Thr | Cys | Xaa' | Xaa' | Xaa' | Gly | Glu | Ile | Cys | Xaa' | Tyr | Ala | Ala | Cys | Thr | Gly | Cys | (SEQID NO: 1033) |
| Pro | Gly | Xaa' | Thr | Cys | Xaa' | Xaa' | Xaa' | Gly | Glu | Ile | Cys | Ala | Xaa' | Ala | Ala | Cys | Thr | Gly | Cys | (SEQID NO: 1034) |
| Pro | Gly | Xaa' | Thr | Cys | Xaa' | Xaa' | Xaa' | Gly | Glu | Ile | Cys | Ala | Tyr | Xaa' | Ala | Cys | Thr | Gly | Cys | (SEQID NO: 1035) |
| Pro | Gly | Xaa' | Thr | Cys | Xaa' | Xaa' | Xaa' | Gly | Glu | Ile | Cys | Ala | Tyr | Ala | Xaa' | Cys | Thr | Gly | Cys | (SEQID NO: 1036) |
| Pro | Gly | Xaa' | Thr | Cys | Xaa' | Xaa' | Xaa' | Gly | Glu | Ile | Cys | Ala | Tyr | Ala | Ala | Cys | Xaa' | Gly | Cys | (SEQID NO: 1037) |
| Pro | Gly | Xaa' | Thr | Cys | Xaa' | Xaa' | Xaa' | Gly | Glu | Ile | Cys | Ala | Tyr | Ala | Ala | Cys | Thr | Xaa' | Cys | (SEQID NO: 1038) |
| Pro | Gly | Xaa' | Thr | Cys | Xaa' | Xaa' | Xaa' | Gly | Glu | Ile | Cys | Ala | Tyr | Xaa' | Ala | Cys | Thr | Gly | Cys | (SEQID NO: 1039) |
| Pro | Gly | Xaa' | Thr | Cys | Xaa' | Xaa' | Xaa' | Gly | Glu | Ile | Cys | Ala | Tyr | Ala | Xaa' | Cys | Thr | Gly | Cys | (SEQID NO: 1040) |
| Pro | Gly | Xaa' | Thr | Cys | Xaa' | Xaa' | Xaa' | Gly | Glu | Ile | Cys | Ala | Tyr | Ala | Ala | Xaa' | Thr | Gly | Cys | (SEQID NO: 1041) |
| Pro | Gly | Xaa' | Thr | Cys | Xaa' | Xaa' | Xaa' | Gly | Glu | Ile | Cys | Ala | Tyr | Ala | Ala | Cys | Thr | Gly | Xaa' | (SEQID NO: 1042) |
| Pro | Gly | Xaa' | Thr | Cys | Xaa' | Xaa' | Xaa' | Gly | Glu | Ile | Cys | Ala | Tyr | Ala | Ala | Cys | Thr | Gly | Cys | (SEQID NO: 1043) |
| Pro | Gly | Xaa' | Thr | Cys | Xaa' | Xaa' | Xaa' | Gly | Glu | Ile | Cys | Ala | Tyr | Ala | Ala | Cys | Thr | Gly | Cys | (SEQID NO: 1044) |
| Pro | Gly | Xaa' | Thr | Cys | Xaa' | Xaa' | Xaa' | Gly | Glu | Ile | Cys | Ala | Tyr | Ala | Ala | Cys | Thr | Gly | Cys | (SEQID NO: 1045) |
| Pro | Gly | Xaa' | Thr | Cys | Xaa' | Xaa' | Xaa' | Gly | Glu | Ile | Cys | Ala | Tyr | Ala | Ala | Cys | Thr | Gly | Cys | (SEQID NO: 1046) |
| Pro | Gly | Xaa' | Thr | Cys | Xaa' | Xaa' | Xaa' | Gly | Xaa' | Ile | Cys | Ala | Tyr | Ala | Ala | Cys | Thr | Gly | Cys | (SEQID NO: 1047) |
| Pro | Gly | Xaa' | Thr | Cys | Xaa' | Xaa' | Xaa' | Gly | Glu | Xaa' | Cys | Ala | Tyr | Ala | Ala | Cys | Thr | Gly | Cys | (SEQID NO: 1048) |
| Pro | Gly | Xaa' | Thr | Cys | Xaa' | Xaa' | Xaa' | Gly | Glu | Ile | Cys | Xaa' | Tyr | Ala | Ala | Cys | Thr | Gly | Cys | (SEQID NO: 1049) |
| Pro | Gly | Xaa' | Thr | Cys | Xaa' | Xaa' | Xaa' | Gly | Glu | Ile | Cys | Ala | Xaa' | Ala | Ala | Cys | Thr | Gly | Cys | (SEQID NO: 1050) |
| Pro | Gly | Xaa' | Thr | Cys | Xaa' | Xaa' | Xaa' | Gly | Glu | Ile | Cys | Ala | Tyr | Xaa' | Ala | Cys | Thr | Gly | Cys | (SEQID NO: 1051) |
| Pro | Gly | Xaa' | Thr | Cys | Xaa' | Xaa' | Xaa' | Gly | Glu | Ile | Cys | Ala | Tyr | Ala | Xaa' | Cys | Thr | Gly | Cys | (SEQID NO: 1052) |
| Pro | Gly | Xaa' | Thr | Cys | Xaa' | Xaa' | Xaa' | Gly | Glu | Ile | Cys | Ala | Tyr | Ala | Ala | Cys | Xaa' | Gly | Cys | (SEQID NO: 1053) |
| Pro | Gly | Xaa' | Thr | Cys | Xaa' | Xaa' | Xaa' | Gly | Glu | Ile | Cys | Ala | Tyr | Ala | Ala | Cys | Thr | Xaa' | Cys | (SEQID NO: 1054) |
| Pro | Gly | Xaa' | Thr | Cys | Xaa' | Xaa' | Xaa' | Gly | Glu | Ile | Cys | Ala | Tyr | Ala | Ala | Cys | Thr | Gly | Xaa' | (SEQID NO: 1055) |
| Pro | Gly | Xaa' | Thr | Cys | Gly | Xaa' | Xaa' | Xaa' | Glu | Ile | Cys | Ala | Tyr | Ala | Ala | Cys | Thr | Gly | Cys | (SEQID NO: 1056) |
| Pro | Gly | Xaa' | Thr | Cys | Xaa' | Gly | Xaa' | Xaa' | Xaa' | Glu | Ile | Cys | Ala | Tyr | Ala | Ala | Cys | Thr | Gly | Cys | (SEQID NO: 1057) |
| Pro | Gly | Xaa' | Thr | Cys | Xaa' | Xaa' | Gly | Xaa' | Xaa' | Xaa' | Glu | Ile | Cys | Ala | Tyr | Ala | Ala | Cys | Thr | Gly | Cys | (SEQID NO: 1058) |

FIG. 2

| | |
|---|---|
| Pro Gly Xaa' Thr Xaa' Cys Gly Xaa' Glu Ile Xaa' Cys Ala Tyr Ala Ala Cys Thr Gly Cys | (SEQ ID NO: 1059) |
| Pro Gly Xaa' Thr Xaa' Cys Gly Xaa' Glu Ile Xaa' Cys Ala Tyr Ala Ala Cys Thr Gly Cys | (SEQ ID NO: 1060) |
| Pro Gly Xaa' Thr Xaa' Cys Gly Xaa' Glu Ile Xaa' Cys Ala Xaa' Tyr Ala Ala Cys Thr Gly Cys | (SEQ ID NO: 1061) |
| Pro Gly Xaa' Thr Xaa' Cys Gly Xaa' Glu Ile Xaa' Cys Ala Tyr Xaa' Ala Ala Cys Thr Gly Cys | (SEQ ID NO: 1062) |
| Pro Gly Xaa' Thr Xaa' Cys Gly Xaa' Glu Ile Xaa' Cys Ala Tyr Ala Xaa' Ala Cys Thr Gly Cys | (SEQ ID NO: 1063) |
| Pro Gly Xaa' Thr Xaa' Cys Gly Xaa' Glu Ile Xaa' Cys Ala Tyr Ala Ala Xaa' Cys Thr Gly Cys | (SEQ ID NO: 1064) |
| Pro Gly Xaa' Thr Xaa' Cys Gly Xaa' Glu Ile Xaa' Cys Ala Tyr Ala Ala Cys Xaa' Thr Gly Cys | (SEQ ID NO: 1065) |
| Pro Gly Xaa' Thr Xaa' Cys Gly Xaa' Glu Ile Xaa' Cys Ala Tyr Ala Ala Cys Thr Xaa' Gly Cys | (SEQ ID NO: 1066) |
| Pro Gly Xaa' Thr Xaa' Cys Gly Xaa' Glu Ile Xaa' Cys Ala Tyr Ala Ala Cys Thr Gly Xaa' Cys | (SEQ ID NO: 1067) |
| Pro Gly Xaa' Thr Xaa' Cys Gly Xaa' Glu Ile Xaa' Cys Ala Tyr Ala Ala Cys Thr Gly Cys Xaa' | (SEQ ID NO: 1068) |
| Pro Gly Xaa' Thr Xaa' Cys Gly Xaa' Glu Ile Cys Xaa' Ala Tyr Ala Ala Cys Thr Gly Cys | (SEQ ID NO: 1069) |
| Pro Gly Xaa' Thr Xaa' Cys Gly Xaa' Glu Xaa' Ile Cys Ala Tyr Ala Ala Cys Thr Gly Cys | (SEQ ID NO: 1070) |
| Pro Gly Xaa' Thr Xaa' Cys Gly Xaa' Glu Ile Xaa' Cys Ala Tyr Xaa' Ala Ala Cys Thr Gly Cys | (SEQ ID NO: 1071) |
| Pro Gly Xaa' Thr Xaa' Cys Gly Xaa' Glu Ile Xaa' Cys Ala Xaa' Tyr Ala Ala Cys Thr Gly Cys | (SEQ ID NO: 1072) |
| Pro Gly Xaa' Thr Xaa' Cys Gly Xaa' Glu Ile Xaa' Cys Ala Tyr Ala Xaa' Ala Cys Thr Gly Cys | (SEQ ID NO: 1073) |
| Pro Gly Xaa' Thr Xaa' Cys Gly Xaa' Glu Ile Xaa' Cys Ala Tyr Ala Ala Xaa' Cys Thr Gly Cys | (SEQ ID NO: 1074) |
| Pro Gly Xaa' Thr Xaa' Cys Gly Xaa' Glu Ile Xaa' Cys Ala Tyr Ala Ala Cys Xaa' Thr Gly Cys | (SEQ ID NO: 1075) |
| Pro Gly Xaa' Thr Xaa' Cys Gly Xaa' Glu Ile Xaa' Cys Ala Tyr Ala Ala Cys Thr Xaa' Gly Cys | (SEQ ID NO: 1076) |
| Pro Gly Xaa' Thr Xaa' Cys Gly Xaa' Glu Ile Xaa' Cys Ala Tyr Ala Ala Xaa' Cys Thr Gly Cys | (SEQ ID NO: 1077) |
| Pro Gly Xaa' Thr Xaa' Cys Gly Xaa' Glu Ile Xaa' Cys Ala Tyr Ala Ala Cys Thr Gly Xaa' Cys | (SEQ ID NO: 1078) |
| Pro Gly Xaa' Thr Xaa' Cys Gly Xaa' Glu Ile Xaa' Cys Ala Tyr Ala Ala Cys Thr Gly Cys Xaa' | (SEQ ID NO: 1079) |
| Pro Gly Xaa' Thr Xaa' Cys Gly. Xaa' Glu Ile Xaa' Cys Ala Tyr Ala Ala Cys Thr Gly Cys | (SEQ ID NO: 1080) |
| Pro Gly Xaa' Thr Xaa' Cys Gly Xaa' Glu Ile Ile Xaa' Cys Ala Tyr Ala Ala Cys Thr Gly Cys | (SEQ ID NO: 1081) |
| Pro Gly Xaa' Thr Xaa' Cys Gly Xaa' Glu Ile Xaa' Cys Ala Xaa' Tyr Ala Ala Cys Thr Gly Cys | (SEQ ID NO: 1082) |
| Pro Gly Xaa' Thr Xaa' Cys Gly Xaa' Glu Ile Xaa' Cys Ala Tyr Xaa' Ala Ala Cys Thr Gly Cys | (SEQ ID NO: 1083) |
| Pro Gly Xaa' Thr Xaa' Cys Gly Xaa' Glu Ile Xaa' Cys Ala Tyr Ala Xaa' Ala Cys Thr Gly Cys | (SEQ ID NO: 1084) |
| Pro Gly Xaa' Thr Xaa' Cys Gly Xaa' Glu Ile Xaa' Cys Ala Tyr Ala Ala Xaa' Cys Thr Gly Cys | (SEQ ID NO: 1085) |
| Pro Gly Xaa' Thr Xaa' Cys Gly Xaa' Glu Ile Xaa' Cys Ala Tyr Ala Ala Cys Xaa' Thr Gly Cys | (SEQ ID NO: 1086) |
| Pro Gly Xaa' Thr Xaa' Cys Gly Xaa' Glu Ile Xaa' Cys Ala Tyr Ala Ala Cys Thr Xaa' Gly Cys | (SEQ ID NO: 1087) |
| Pro Gly Xaa' Thr Xaa' Cys Gly Xaa' Glu Ile Xaa' Cys Ala Tyr Ala Ala Xaa' Cys Thr Gly Cys | (SEQ ID NO: 1088) |
| Pro Gly Xaa' Thr Xaa' Cys Gly Xaa' Glu Ile Xaa' Cys Ala Tyr Ala Ala Cys Thr Gly Xaa' Cys | (SEQ ID NO: 1089) |
| Pro Gly Xaa' Thr Xaa' Cys Gly Xaa' Glu Ile Xaa' Cys Ala Tyr Ala Ala Cys Thr Gly Cys Xaa' | (SEQ ID NO: 1090) |
| Pro Gly Xaa' Thr Xaa' Cys Gly Glu Ile Cys Xaa' Ala Tyr Ala Ala Cys Thr Gly Cys Xaa' | (SEQ ID NO: 1091) |
| Pro Gly Xaa' Thr Xaa' Cys Gly Xaa' Glu Ile Cys Xaa' Ala Tyr Ala Ala Cys Thr Gly Cys | (SEQ ID NO: 1092) |

FIG. 2

```
Pro Gly Xaa' Cys Gly Glu Ile Cys Xaa' Xaa' Ala Tyr Ala Ala Cys Thr Gly Cys      (SEQ ID NO: 1093)
Pro Gly Xaa' Thr Xaa' Cys Gly Glu Ile Cys Xaa' Ala Xaa' Tyr Ala Ala Cys Thr Gly Cys      (SEQ ID NO: 1094)
Pro Gly Xaa' Thr Xaa' Cys Gly Glu Ile Cys Xaa' Ala Tyr Xaa' Ala Ala Cys Thr Gly Cys      (SEQ ID NO: 1095)
Pro Gly Xaa' Thr Xaa' Cys Gly Glu Ile Cys Xaa' Ala Tyr Ala Xaa' Ala Cys Thr Gly Cys      (SEQ ID NO: 1096)
Pro Gly Xaa' Thr Xaa' Cys Gly Glu Ile Cys Xaa' Ala Tyr Ala Ala Xaa' Cys Thr Gly Cys      (SEQ ID NO: 1097)
Pro Gly Xaa' Thr Xaa' Cys Gly Glu Ile Cys Xaa' Ala Tyr Ala Ala Cys Xaa' Thr Gly Cys      (SEQ ID NO: 1098)
Pro Gly Xaa' Thr Xaa' Cys Gly Glu Ile Cys Xaa' Ala Tyr Ala Ala Cys Thr Xaa' Gly Cys      (SEQ ID NO: 1099)
Pro Gly Xaa' Thr Xaa' Cys Gly Glu Ile Cys Xaa' Ala Tyr Ala Ala Cys Thr Gly Xaa' Cys      (SEQ ID NO: 1100)
Pro Gly Xaa' Thr Xaa' Cys Gly Glu Ile Cys Xaa' Ala Tyr Ala Ala Cys Thr Gly Cys Xaa'      (SEQ ID NO: 1101)
Pro Gly Xaa' Thr Xaa' Cys Gly Glu Ile Cys Ala Xaa' Tyr Ala Ala Cys Thr Gly Cys           (SEQ ID NO: 1102)
Pro Gly Xaa' Thr Xaa' Cys Gly Glu Ile Cys Ala Xaa' Xaa' Tyr Ala Ala Cys Thr Gly Cys      (SEQ ID NO: 1103)
Pro Gly Xaa' Thr Xaa' Cys Gly Glu Ile Cys Ala Xaa' Tyr Xaa' Ala Ala Cys Thr Gly Cys      (SEQ ID NO: 1104)
Pro Gly Xaa' Thr Xaa' Cys Gly Glu Ile Cys Ala Xaa' Tyr Ala Xaa' Ala Cys Thr Gly Cys      (SEQ ID NO: 1105)
Pro Gly Xaa' Thr Xaa' Cys Gly Glu Ile Cys Ala Xaa' Tyr Ala Ala Xaa' Cys Thr Gly Cys      (SEQ ID NO: 1106)
Pro Gly Xaa' Thr Xaa' Cys Gly Glu Ile Cys Ala Xaa' Tyr Ala Ala Cys Xaa' Thr Gly Cys      (SEQ ID NO: 1107)
Pro Gly Xaa' Thr Xaa' Cys Gly Glu Ile Cys Ala Xaa' Tyr Ala Ala Cys Thr Xaa' Gly Cys      (SEQ ID NO: 1108)
Pro Gly Xaa' Thr Xaa' Cys Gly Glu Ile Cys Ala Xaa' Tyr Ala Ala Cys Thr Gly Xaa' Cys      (SEQ ID NO: 1109)
Pro Gly Xaa' Thr Xaa' Cys Gly Glu Ile Cys Ala Xaa' Tyr Ala Ala Cys Thr Gly Cys Xaa'      (SEQ ID NO: 1110)
Pro Gly Xaa' Thr Xaa' Cys Gly Glu Ile Cys Ala Tyr Xaa' Ala Ala Cys Thr Gly Cys           (SEQ ID NO: 1111)
Pro Gly Xaa' Thr Xaa' Cys Gly Glu Ile Cys Ala Tyr Xaa' Xaa' Ala Ala Cys Thr Gly Cys      (SEQ ID NO: 1112)
Pro Gly Xaa' Thr Xaa' Cys Gly Glu Ile Cys Ala Tyr Xaa' Ala Xaa' Ala Cys Thr Gly Cys      (SEQ ID NO: 1113)
Pro Gly Xaa' Thr Xaa' Cys Gly Glu Ile Cys Ala Tyr Xaa' Ala Ala Xaa' Cys Thr Gly Cys      (SEQ ID NO: 1114)
Pro Gly Xaa' Thr Xaa' Cys Gly Glu Ile Cys Ala Tyr Xaa' Ala Ala Cys Xaa' Thr Gly Cys      (SEQ ID NO: 1115)
Pro Gly Xaa' Thr Xaa' Cys Gly Glu Ile Cys Ala Tyr Xaa' Ala Ala Cys Thr Xaa' Gly Cys      (SEQ ID NO: 1116)
Pro Gly Xaa' Thr Xaa' Cys Gly Glu Ile Cys Ala Tyr Xaa' Ala Ala Cys Thr Gly Xaa' Cys      (SEQ ID NO: 1117)
Pro Gly Xaa' Thr Xaa' Cys Gly Glu Ile Cys Ala Tyr Xaa' Ala Ala Cys Thr Gly Cys Xaa'      (SEQ ID NO: 1118)
Pro Gly Xaa' Thr Xaa' Cys Gly Glu Ile Cys Ala Tyr Ala Xaa' Ala Cys Thr Gly Cys           (SEQ ID NO: 1119)
Pro Gly Xaa' Thr Xaa' Cys Gly Glu Ile Cys Ala Tyr Ala Xaa' Xaa' Ala Cys Thr Gly Cys      (SEQ ID NO: 1120)
Pro Gly Xaa' Thr Xaa' Cys Gly Glu Ile Cys Ala Tyr Ala Xaa' Ala Xaa' Cys Thr Gly Cys      (SEQ ID NO: 1121)
Pro Gly Xaa' Thr Xaa' Cys Gly Glu Ile Cys Ala Tyr Ala Xaa' Ala Cys Xaa' Thr Gly Cys      (SEQ ID NO: 1122)
Pro Gly Xaa' Thr Xaa' Cys Gly Glu Ile Cys Ala Tyr Ala Xaa' Ala Cys Thr Xaa' Gly Cys      (SEQ ID NO: 1123)
Pro Gly Xaa' Thr Xaa' Cys Gly Glu Ile Cys Ala Tyr Ala Xaa' Ala Cys Thr Gly Xaa' Cys      (SEQ ID NO: 1124)
Pro Gly Xaa' Thr Xaa' Cys Gly Glu Ile Cys Ala Tyr Ala Xaa' Ala Cys Thr Gly Cys Xaa'      (SEQ ID NO: 1125)
Pro Gly Xaa' Thr Xaa' Cys Gly Glu Ile Cys Ala Tyr Ala Ala Xaa' Cys Thr Gly Cys           (SEQ ID NO: 1126)
```

FIG. 2

Pro Gly Xaa' Thr Xaa' Cys Gly Glu Ile Cys Ala Tyr Ala Ala Xaa' Xaa' Cys Thr Gly Cys (SEQID NO: 1127)
Pro Gly Xaa' Thr Xaa' Cys Gly Glu Ile Cys Ala Tyr Ala Ala Xaa' Cys Xaa' Thr Gly Cys (SEQID NO: 1128)
Pro Gly Xaa' Thr Xaa' Cys Gly Glu Ile Cys Ala Tyr Ala Ala Xaa' Cys Thr Xaa' Gly Cys (SEQID NO: 1129)
Pro Gly Xaa' Thr Xaa' Cys Gly Glu Ile Cys Ala Tyr Ala Ala Xaa' Cys Thr Gly Xaa' Cys (SEQID NO: 1130)
Pro Gly Xaa' Thr Xaa' Cys Gly Glu Ile Cys Ala Tyr Ala Ala Xaa' Cys Thr Gly Cys Xaa' (SEQID NO: 1131)
Pro Gly Xaa' Thr Xaa' Cys Gly Glu Ile Cys Ala Tyr Ala Ala Cys Xaa' Xaa' Thr Gly Cys (SEQID NO: 1132)
Pro Gly Xaa' Thr Xaa' Cys Gly Glu Ile Cys Ala Tyr Ala Ala Cys Xaa' Thr Xaa' Gly Cys (SEQID NO: 1133)
Pro Gly Xaa' Thr Xaa' Cys Gly Glu Ile Cys Ala Tyr Ala Ala Cys Xaa' Thr Gly Xaa' Cys (SEQID NO: 1134)
Pro Gly Xaa' Thr Xaa' Cys Gly Glu Ile Cys Ala Tyr Ala Ala Cys Xaa' Thr Gly Cys Xaa' (SEQID NO: 1135)
Pro Gly Xaa' Thr Xaa' Cys Gly Glu Ile Cys Ala Tyr Ala Ala Cys Thr Xaa' Xaa' Gly Cys (SEQID NO: 1136)
Pro Gly Xaa' Thr Xaa' Cys Gly Glu Ile Cys Ala Tyr Ala Ala Cys Thr Xaa' Gly Cys Xaa' (SEQID NO: 1137)
Pro Gly Xaa' Thr Xaa' Cys Gly Glu Ile Cys Ala Tyr Ala Ala Cys Thr Xaa' Xaa' Gly Cys (SEQID NO: 1138)
Pro Gly Xaa' Thr Xaa' Cys Gly Glu Ile Cys Ala Tyr Ala Ala Cys Thr Gly Xaa' Cys Xaa' (SEQID NO: 1139)
Pro Gly Xaa' Thr Xaa' Cys Gly Glu Ile Cys Ala Tyr Ala Ala Cys Thr Gly Cys Xaa' Xaa' (SEQID NO: 1140)
Pro Gly Xaa' Thr Cys Xaa' Gly Glu Ile Cys Ala Tyr Ala Ala Cys Thr Gly Xaa' Cys (SEQID NO: 1141)
Pro Gly Xaa' Thr Cys Xaa' Gly Glu Ile Cys Ala Tyr Ala Ala Cys Thr Gly Cys Xaa' (SEQID NO: 1142)
Pro Gly Xaa' Thr Cys Xaa' Gly Xaa' Glu Ile Cys Ala Tyr Ala Ala Cys Thr Gly Xaa' Cys Xaa' (SEQID NO: 1143)
Pro Gly Xaa' Thr Cys Xaa' Gly Glu Ile Xaa' Cys Ala Tyr Ala Ala Cys Thr Gly Cys Xaa' (SEQID NO: 1144)
Pro Gly Xaa' Thr Cys Xaa' Gly Glu Ile Cys Xaa' Ala Tyr Ala Ala Cys Thr Gly Cys Xaa' (SEQID NO: 1145)
Pro Gly Xaa' Thr Cys Xaa' Gly Glu Ile Cys Ala Xaa' Tyr Ala Ala Cys Thr Gly Cys (SEQID NO: 1146)
Pro Gly Xaa' Thr Cys Xaa' Gly Glu Ile Cys Ala Tyr Ala Ala Cys Thr Gly Cys (SEQID NO: 1147)
Pro Gly Xaa' Thr Cys Xaa' Gly Xaa' Glu Ile Cys Ala Tyr Ala Ala Tyr Ala Ala Cys Thr Gly Cys (SEQID NO: 1148)
Pro Gly Xaa' Thr Cys Xaa' Gly Ile Cys Ala Tyr Xaa' Ala Ala Cys Thr Gly Cys (SEQID NO: 1149)
Pro Gly Xaa' Thr Cys Xaa' Gly Glu Ile Cys Ala Tyr Ala Xaa' Ala Cys Thr Gly Cys (SEQID NO: 1150)
Pro Gly Xaa' Thr Cys Xaa' Gly Glu Ile Cys Ala Tyr Ala Ala Xaa' Cys Thr Gly Cys (SEQID NO: 1151)
Pro Gly Xaa' Thr Cys Xaa' Gly Glu Ile Xaa' Cys Ala Tyr Ala Ala Cys Thr Gly Cys (SEQID NO: 1152)
Pro Gly Xaa' Thr Cys Xaa' Gly Glu Ile Cys Ala Xaa' Tyr Ala Ala Cys Thr Gly Cys (SEQID NO: 1153)
Pro Gly Xaa' Thr Cys Xaa' Gly Glu Ile Cys Ala Tyr Xaa' Ala Ala Cys Thr Gly Cys (SEQID NO: 1154)
Pro Gly Xaa' Thr Cys Xaa' Gly Glu Ile Cys Ala Tyr Ala Xaa' Ala Cys Thr Gly Cys (SEQID NO: 1155)
Pro Gly Xaa' Thr Cys Xaa' Gly Glu Ile Cys Ala Tyr Ala Ala Xaa' Cys Thr Gly Cys (SEQID NO: 1156)
Pro Gly Xaa' Thr Cys Xaa' Gly Glu Ile Cys Ala Tyr Ala Ala Cys Xaa' Thr Gly Cys (SEQID NO: 1157)
Pro Gly Xaa' Thr Cys Xaa' Gly Glu Ile Cys Ala Tyr Ala Ala Cys Thr Xaa' Gly Cys (SEQID NO: 1158)
Pro Gly Xaa' Thr Cys Xaa' Gly Glu Ile Cys Ala Tyr Ala Ala Cys Thr Gly Xaa' Cys (SEQID NO: 1159)
Pro Gly Xaa' Thr Cys Xaa' Gly Glu Ile Cys Ala Tyr Ala Ala Cys Thr Gly Cys Xaa' (SEQID NO: 1160)

FIG. 2

| Pro Gly Xaa' Thr Cys Xaa' Gly Xaa' Glu Ile Cys Ala Tyr Ala Ala Cys Thr Gly Cys | (SEQ ID NO: 1161) |
| Pro Gly Xaa' Thr Cys Xaa' Gly Xaa' Glu Xaa' Ile Cys Ala Tyr Ala Ala Cys Thr Gly Cys | (SEQ ID NO: 1162) |
| Pro Gly Xaa' Thr Cys Xaa' Gly Xaa' Glu Ile Xaa' Cys Ala Tyr Ala Ala Cys Thr Gly Cys | (SEQ ID NO: 1163) |
| Pro Gly Xaa' Thr Cys Xaa' Gly Xaa' Glu Ile Cys Xaa' Ala Tyr Ala Ala Cys Thr Gly Cys | (SEQ ID NO: 1164) |
| Pro Gly Xaa' Thr Cys Xaa' Gly Xaa' Glu Ile Cys Ala Xaa' Tyr Ala Ala Cys Thr Gly Cys | (SEQ ID NO: 1165) |
| Pro Gly Xaa' Thr Cys Xaa' Gly Xaa' Glu Ile Cys Ala Tyr Xaa' Ala Ala Cys Thr Gly Cys | (SEQ ID NO: 1166) |
| Pro Gly Xaa' Thr Cys Xaa' Gly Xaa' Glu Ile Cys Ala Tyr Ala Xaa' Ala Cys Thr Gly Cys | (SEQ ID NO: 1167) |
| Pro Gly Xaa' Thr Cys Xaa' Gly Xaa' Glu Ile Cys Ala Tyr Ala Ala Xaa' Cys Thr Gly Cys | (SEQ ID NO: 1168) |
| Pro Gly Xaa' Thr Cys Xaa' Gly Xaa' Glu Ile Cys Ala Tyr Ala Ala Cys Xaa' Thr Gly Cys | (SEQ ID NO: 1169) |
| Pro Gly Xaa' Thr Cys Xaa' Gly Xaa' Glu Ile Cys Ala Tyr Ala Ala Cys Thr Xaa' Gly Cys | (SEQ ID NO: 1170) |
| Pro Gly Xaa' Thr Cys Xaa' Gly Xaa' Glu Ile Cys Ala Tyr Ala Ala Cys Thr Gly Xaa' Cys | (SEQ ID NO: 1171) |
| Pro Gly Xaa' Thr Cys Xaa' Gly Xaa' Glu Ile Cys Ala Tyr Ala Ala Cys Thr Gly Cys Xaa' | (SEQ ID NO: 1172) |
| Pro Gly Xaa' Thr Cys Xaa' Gly Glu Xaa' Ile Cys Ala Tyr Ala Ala Cys Thr Gly Cys | (SEQ ID NO: 1173) |
| Pro Gly Xaa' Thr Cys Xaa' Gly Glu Ile Xaa' Cys Ala Tyr Ala Ala Cys Thr Gly Cys | (SEQ ID NO: 1174) |
| Pro Gly Xaa' Thr Cys Xaa' Gly Glu Xaa' Ile Cys Ala Tyr Ala Ala Cys Thr Gly Cys | (SEQ ID NO: 1175) |
| Pro Gly Xaa' Thr Cys Xaa' Gly Glu Xaa' Ile Cys Xaa' Ala Tyr Ala Ala Cys Thr Gly Cys | (SEQ ID NO: 1176) |
| Pro Gly Xaa' Thr Cys Xaa' Gly Glu Xaa' Ile Cys Ala Xaa' Tyr Ala Ala Cys Thr Gly Cys | (SEQ ID NO: 1177) |
| Pro Gly Xaa' Thr Cys Xaa' Gly Glu Xaa' Ile Cys Ala Tyr Xaa' Ala Ala Cys Thr Gly Cys | (SEQ ID NO: 1178) |
| Pro Gly Xaa' Thr Cys Xaa' Gly Glu Xaa' Ile Cys Ala Tyr Ala Xaa' Ala Cys Thr Gly Cys | (SEQ ID NO: 1179) |
| Pro Gly Xaa' Thr Cys Xaa' Gly Glu Xaa' Ile Cys Ala Tyr Ala Ala Xaa' Cys Thr Gly Cys | (SEQ ID NO: 1180) |
| Pro Gly Xaa' Thr Cys Xaa' Gly Glu Xaa' Ile Cys Ala Tyr Ala Ala Cys Xaa' Thr Gly Cys | (SEQ ID NO: 1181) |
| Pro Gly Xaa' Thr Cys Xaa' Gly Glu Xaa' Ile Cys Ala Tyr Ala Ala Cys Thr Xaa' Gly Cys | (SEQ ID NO: 1182) |
| Pro Gly Xaa' Thr Cys Xaa' Gly Glu Xaa' Ile Cys Ala Tyr Ala Ala Cys Thr Gly Xaa' Cys | (SEQ ID NO: 1183) |
| Pro Gly Xaa' Thr Cys Xaa' Gly Glu Xaa' Ile Cys Ala Tyr Ala Ala Cys Thr Gly Cys Xaa' | (SEQ ID NO: 1184) |
| Pro Gly Xaa' Thr Cys Xaa' Gly Glu Ile Xaa' Cys Ala Tyr Ala Ala Cys Thr Gly Cys | (SEQ ID NO: 1185) |
| Pro Gly Xaa' Thr Cys Xaa' Gly Glu Ile Xaa' Cys Xaa' Ala Tyr Ala Ala Cys Thr Gly Cys | (SEQ ID NO: 1186) |
| Pro Gly Xaa' Thr Cys Xaa' Gly Glu Ile Xaa' Cys Ala Xaa' Tyr Ala Ala Cys Thr Gly Cys | (SEQ ID NO: 1187) |
| Pro Gly Xaa' Thr Cys Xaa' Gly Glu Ile Xaa' Cys Ala Tyr Xaa' Ala Ala Cys Thr Gly Cys | (SEQ ID NO: 1188) |
| Pro Gly Xaa' Thr Cys Xaa' Gly Glu Ile Xaa' Cys Ala Tyr Ala Xaa' Ala Cys Thr Gly Cys | (SEQ ID NO: 1189) |
| Pro Gly Xaa' Thr Cys Xaa' Gly Glu Ile Xaa' Cys Ala Tyr Ala Ala Xaa' Cys Thr Gly Cys | (SEQ ID NO: 1190) |
| Pro Gly Xaa' Thr Cys Xaa' Gly Glu Ile Xaa' Cys Ala Tyr Ala Ala Cys Xaa' Thr Gly Cys | (SEQ ID NO: 1191) |
| Pro Gly Xaa' Thr Cys Xaa' Gly Glu Ile Xaa' Cys Ala Tyr Ala Ala Cys Thr Xaa' Gly Cys | (SEQ ID NO: 1192) |
| Pro Gly Xaa' Thr Cys Xaa' Gly Glu Ile Xaa' Cys Ala Tyr Ala Ala Cys Thr Gly Xaa' Cys | (SEQ ID NO: 1193) |
| Pro Gly Xaa' Thr Cys Xaa' Gly Ile Xaa' Cys Ala Tyr Ala Ala Cys Thr Xaa' Gly Cys | (SEQ ID NO: 1194) |

FIG. 2

| | | | | | | | | | | | | | | |
|---|---|---|---|---|---|---|---|---|---|---|---|---|---|---|
| Pro | Gly | Xaa' | Thr | Cys | Xaa' | Gly | Glu | Ile | Xaa' | Cys | Ala | Tyr | Ala | Ala | Cys | Thr | Gly | Xaa' | Cys | (SEQ ID NO: 1195) |
| Pro | Gly | Xaa' | Thr | Cys | Xaa' | Gly | Glu | Ile | Xaa' | Cys | Ala | Tyr | Ala | Ala | Cys | Thr | Gly | Cys | Xaa' | (SEQ ID NO: 1196) |
| Pro | Gly | Xaa' | Thr | Cys | Xaa' | Gly | Glu | Ile | Cys | Xaa' | Ala | Tyr | Ala | Ala | Cys | Thr | Gly | Cys | | (SEQ ID NO: 1197) |
| Pro | Gly | Xaa' | Thr | Cys | Xaa' | Gly | Glu | Ile | Cys | Xaa' | Ala | Tyr | Ala | Xaa' | Cys | Thr | Gly | Gly | Cys | (SEQ ID NO: 1198) |
| Pro | Gly | Xaa' | Thr | Cys | Xaa' | Gly | Glu | Ile | Cys | Xaa' | Ala | Tyr | Xaa' | Ala | Cys | Thr | Gly | Gly | Cys | (SEQ ID NO: 1199) |
| Pro | Gly | Xaa' | Thr | Cys | Xaa' | Gly | Glu | Ile | Cys | Xaa' | Ala | Xaa' | Ala | Ala | Cys | Thr | Gly | Gly | Cys | (SEQ ID NO: 1200) |
| Pro | Gly | Xaa' | Thr | Cys | Xaa' | Gly | Glu | Ile | Cys | Xaa' | Xaa' | Tyr | Ala | Ala | Cys | Thr | Gly | Gly | Cys | (SEQ ID NO: 1201) |
| Pro | Gly | Xaa' | Thr | Cys | Xaa' | Gly | Glu | Ile | Cys | Xaa' | Ala | Tyr | Ala | Ala | Xaa' | Thr | Gly | Gly | Cys | (SEQ ID NO: 1202) |
| Pro | Gly | Xaa' | Thr | Cys | Xaa' | Gly | Glu | Ile | Cys | Xaa' | Ala | Tyr | Ala | Ala | Cys | Xaa' | Gly | Gly | Cys | (SEQ ID NO: 1203) |
| Pro | Gly | Xaa' | Thr | Cys | Xaa' | Gly | Glu | Ile | Cys | Xaa' | Ala | Tyr | Ala | Ala | Cys | Thr | Gly | Xaa' | Cys | (SEQ ID NO: 1204) |
| Pro | Gly | Xaa' | Thr | Cys | Xaa' | Gly | Glu | Ile | Cys | Xaa' | Ala | Tyr | Ala | Ala | Cys | Thr | Gly | Cys | Xaa' | (SEQ ID NO: 1205) |
| Pro | Gly | Xaa' | Thr | Cys | Xaa' | Gly | Glu | Ile | Cys | Ala | Xaa' | Tyr | Ala | Ala | Cys | Thr | Gly | Gly | Cys | (SEQ ID NO: 1206) |
| Pro | Gly | Xaa' | Thr | Cys | Xaa' | Gly | Glu | Ile | Cys | Ala | Xaa' | Xaa' | Ala | Ala | Cys | Thr | Gly | Gly | Cys | (SEQ ID NO: 1207) |
| Pro | Gly | Xaa' | Thr | Cys | Xaa' | Gly | Glu | Ile | Cys | Ala | Xaa' | Tyr | Ala | Ala | Cys | Thr | Gly | Gly | Cys | (SEQ ID NO: 1208) |
| Pro | Gly | Xaa' | Thr | Cys | Xaa' | Gly | Glu | Ile | Cys | Ala | Xaa' | Tyr | Xaa' | Ala | Cys | Thr | Gly | Gly | Cys | (SEQ ID NO: 1209) |
| Pro | Gly | Xaa' | Thr | Cys | Xaa' | Gly | Glu | Ile | Cys | Ala | Xaa' | Tyr | Ala | Xaa' | Cys | Thr | Gly | Gly | Cys | (SEQ ID NO: 1210) |
| Pro | Gly | Xaa' | Thr | Cys | Xaa' | Gly | Glu | Ile | Cys | Ala | Xaa' | Tyr | Ala | Ala | Xaa' | Thr | Gly | Gly | Cys | (SEQ ID NO: 1211) |
| Pro | Gly | Xaa' | Thr | Cys | Xaa' | Gly | Glu | Ile | Cys | Ala | Xaa' | Tyr | Ala | Ala | Cys | Xaa' | Gly | Gly | Cys | (SEQ ID NO: 1212) |
| Pro | Gly | Xaa' | Thr | Cys | Xaa' | Gly | Glu | Ile | Cys | Ala | Xaa' | Tyr | Ala | Ala | Cys | Thr | Xaa' | Gly | Cys | (SEQ ID NO: 1213) |
| Pro | Gly | Xaa' | Thr | Cys | Xaa' | Gly | Glu | Ile | Cys | Ala | Xaa' | Tyr | Ala | Ala | Cys | Thr | Gly | Xaa' | Cys | (SEQ ID NO: 1214) |
| Pro | Gly | Xaa' | Thr | Cys | Xaa' | Gly | Glu | Ile | Cys | Ala | Xaa' | Tyr | Ala | Ala | Cys | Thr | Gly | Cys | Xaa' | (SEQ ID NO: 1215) |
| Pro | Gly | Xaa' | Thr | Cys | Xaa' | Gly | Glu | Ile | Cys | Ala | Tyr | Xaa' | Ala | Ala | Cys | Thr | Gly | Gly | Cys | (SEQ ID NO: 1216) |
| Pro | Gly | Xaa' | Thr | Cys | Xaa' | Gly | Glu | Ile | Cys | Ala | Tyr | Xaa' | Xaa' | Ala | Cys | Thr | Gly | Gly | Cys | (SEQ ID NO: 1217) |
| Pro | Gly | Xaa' | Thr | Cys | Xaa' | Gly | Glu | Ile | Cys | Ala | Tyr | Xaa' | Ala | Xaa' | Cys | Thr | Gly | Gly | Cys | (SEQ ID NO: 1218) |
| Pro | Gly | Xaa' | Thr | Cys | Xaa' | Gly | Glu | Ile | Cys | Ala | Tyr | Xaa' | Ala | Ala | Xaa' | Thr | Gly | Gly | Cys | (SEQ ID NO: 1219) |
| Pro | Gly | Xaa' | Thr | Cys | Xaa' | Gly | Glu | Ile | Cys | Ala | Tyr | Xaa' | Ala | Ala | Cys | Xaa' | Gly | Gly | Cys | (SEQ ID NO: 1220) |
| Pro | Gly | Xaa' | Thr | Cys | Xaa' | Gly | Glu | Ile | Cys | Ala | Tyr | Xaa' | Ala | Ala | Cys | Thr | Xaa' | Gly | Cys | (SEQ ID NO: 1221) |
| Pro | Gly | Xaa' | Thr | Cys | Xaa' | Gly | Glu | Ile | Cys | Ala | Tyr | Xaa' | Ala | Ala | Cys | Thr | Gly | Xaa' | Cys | (SEQ ID NO: 1222) |
| Pro | Gly | Xaa' | Thr | Cys | Xaa' | Gly | Glu | Ile | Cys | Ala | Tyr | Xaa' | Ala | Ala | Cys | Thr | Gly | Cys | Xaa' | (SEQ ID NO: 1223) |
| Pro | Gly | Xaa' | Thr | Cys | Xaa' | Gly | Glu | Ile | Cys | Ala | Tyr | Ala | Xaa' | Ala | Cys | Thr | Gly | Gly | Cys | (SEQ ID NO: 1224) |
| Pro | Gly | Xaa' | Thr | Cys | Xaa' | Gly | Glu | Ile | Cys | Ala | Tyr | Ala | Xaa' | Xaa' | Cys | Thr | Gly | Gly | Cys | (SEQ ID NO: 1225) |
| Pro | Gly | Xaa' | Thr | Cys | Xaa' | Gly | Glu | Ile | Cys | Ala | Tyr | Ala | Xaa' | Ala | Xaa' | Thr | Gly | Gly | Cys | (SEQ ID NO: 1226) |
| Pro | Gly | Xaa' | Thr | Cys | Xaa' | Gly | Glu | Ile | Cys | Ala | Tyr | Ala | Xaa' | Ala | Cys | Xaa' | Gly | Gly | Cys | (SEQ ID NO: 1227) |
| Pro | Gly | Xaa' | Thr | Cys | Xaa' | Gly | Glu | Ile | Cys | Ala | Tyr | Ala | Xaa' | Ala | Cys | Thr | Xaa' | Gly | Cys | (SEQ ID NO: 1228) |

FIG. 2

| | | | | | | | | | | | | | |
|---|---|---|---|---|---|---|---|---|---|---|---|---|---|
| Pro | Gly | Xaa' | Thr | Cys | Xaa' | Gly | Glu | Ile | Cys | Ala | Tyr | Ala | Xaa' | Ala | Cys | Thr | Gly | Xaa' | Cys | (SEQID NO: 1229) |
| Pro | Gly | Xaa' | Thr | Cys | Xaa' | Gly | Glu | Ile | Cys | Ala | Tyr | Ala | Xaa' | Ala | Cys | Thr | Gly | Cys | Xaa' | (SEQID NO: 1230) |
| Pro | Gly | Xaa' | Thr | Cys | Xaa' | Gly | Glu | Ile | Cys | Ala | Tyr | Ala | Xaa' | Ala | Cys | Thr | Gly | Cys | Cys | (SEQID NO: 1231) |
| Pro | Gly | Xaa' | Thr | Cys | Xaa' | Gly | Glu | Ile | Cys | Ala | Tyr | Ala | Ala | Xaa' | Cys | Xaa' | Thr | Gly | Cys | (SEQID NO: 1232) |
| Pro | Gly | Xaa' | Thr | Cys | Xaa' | Gly | Glu | Ile | Cys | Ala | Tyr | Ala | Ala | Xaa' | Cys | Xaa' | Cys | Thr | Gly | Cys | (SEQID NO: 1233) |
| Pro | Gly | Xaa' | Thr | Cys | Xaa' | Gly | Glu | Ile | Cys | Ala | Tyr | Ala | Ala | Xaa' | Cys | Thr | Xaa' | Gly | Cys | (SEQID NO: 1234) |
| Pro | Gly | Xaa' | Thr | Cys | Xaa' | Gly | Glu | Ile | Cys | Ala | Tyr | Ala | Ala | Xaa' | Cys | Thr | Gly | Xaa' | Cys | (SEQID NO: 1235) |
| Pro | Gly | Xaa' | Thr | Cys | Xaa' | Gly | Glu | Ile | Cys | Ala | Tyr | Ala | Ala | Xaa' | Cys | Thr | Gly | Xaa' | Cys | (SEQID NO: 1236) |
| Pro | Gly | Xaa' | Thr | Cys | Xaa' | Gly | Glu | Ile | Cys | Ala | Tyr | Ala | Ala | Xaa' | Cys | Thr | Gly | Cys | Xaa' | (SEQID NO: 1237) |
| Pro | Gly | Xaa' | Thr | Cys | Xaa' | Gly | Glu | Ile | Cys | Ala | Tyr | Ala | Ala | Ala | Cys | Xaa' | Thr | Gly | Cys | (SEQID NO: 1238) |
| Pro | Gly | Xaa' | Thr | Cys | Xaa' | Gly | Glu | Ile | Cys | Ala | Tyr | Ala | Ala | Ala | Cys | Xaa' | Xaa' | Thr | Gly | Cys | (SEQID NO: 1239) |
| Pro | Gly | Xaa' | Thr | Cys | Xaa' | Gly | Glu | Ile | Cys | Ala | Tyr | Ala | Ala | Ala | Cys | Xaa' | Thr | Gly | Xaa' | Cys | (SEQID NO: 1240) |
| Pro | Gly | Xaa' | Thr | Cys | Xaa' | Gly | Glu | Ile | Cys | Ala | Tyr | Ala | Ala | Ala | Cys | Xaa' | Thr | Gly | Cys | Xaa' | (SEQID NO: 1241) |
| Pro | Gly | Xaa' | Thr | Cys | Xaa' | Gly | Glu | Ile | Cys | Ala | Tyr | Ala | Ala | Ala | Cys | Thr | Xaa' | Gly | Cys | (SEQID NO: 1242) |
| Pro | Gly | Xaa' | Thr | Cys | Xaa' | Gly | Glu | Ile | Cys | Ala | Tyr | Ala | Ala | Ala | Cys | Thr | Xaa' | Xaa' | Gly | Cys | (SEQID NO: 1243) |
| Pro | Gly | Xaa' | Thr | Cys | Xaa' | Gly | Glu | Ile | Cys | Ala | Tyr | Ala | Ala | Ala | Cys | Thr | Xaa' | Gly | Xaa' | Cys | (SEQID NO: 1244) |
| Pro | Gly | Xaa' | Thr | Cys | Xaa' | Gly | Glu | Ile | Cys | Ala | Tyr | Ala | Ala | Ala | Cys | Thr | Xaa' | Gly | Cys | Xaa' | (SEQID NO: 1245) |
| Pro | Gly | Xaa' | Thr | Cys | Xaa' | Gly | Glu | Ile | Cys | Ala | Tyr | Ala | Ala | Ala | Cys | Thr | Gly | Xaa' | Cys | (SEQID NO: 1246) |
| Pro | Gly | Xaa' | Thr | Cys | Xaa' | Gly | Glu | Ile | Cys | Ala | Tyr | Ala | Ala | Ala | Cys | Thr | Gly | Xaa' | Xaa' | Cys | (SEQID NO: 1247) |
| Pro | Gly | Xaa' | Thr | Cys | Xaa' | Gly | Glu | Ile | Cys | Ala | Tyr | Ala | Ala | Ala | Cys | Thr | Gly | Xaa' | Cys | Xaa' | (SEQID NO: 1248) |
| Pro | Gly | Xaa' | Thr | Cys | Xaa' | Gly | Glu | Ile | Cys | Ala | Tyr | Ala | Ala | Ala | Cys | Thr | Gly | Cys | Xaa' | (SEQID NO: 1249) |
| Pro | Gly | Xaa' | Thr | Cys | Xaa' | Gly | Glu | Ile | Cys | Ala | Tyr | Ala | Ala | Ala | Cys | Thr | Gly | Cys | Xaa' | Xaa' | (SEQID NO: 1250) |
| Pro | Gly | Gly | Thr | Cys | Xaa' | Gly | Glu | Ile | Cys | Ala | Tyr | Ala | Ala | Ala | Cys | Thr | Gly | Cys | (SEQID NO: 1251) |
| Pro | Gly | Xaa' | Thr | Cys | Gly | Gly | Xaa' | Xaa' | Ile | Cys | Ala | Tyr | Ala | Ala | Cys | Thr | Gly | Cys | (SEQID NO: 1252) |
| Pro | Gly | Xaa' | Thr | Cys | Xaa' | Gly | Xaa' | Glu | Ile | Cys | Ala | Tyr | Ala | Ala | Ala | Cys | Thr | Gly | Cys | (SEQID NO: 1253) |
| Pro | Gly | Xaa' | Thr | Cys | Xaa' | Gly | Xaa' | Ile | Cys | Ala | Tyr | Ala | Ala | Ala | Cys | Thr | Gly | Cys | (SEQID NO: 1254) |
| Pro | Gly | Xaa' | Thr | Cys | Xaa' | Gly | Glu | Ile | Cys | Xaa' | Ala | Tyr | Ala | Ala | Ala | Cys | Thr | Gly | Cys | (SEQID NO: 1255) |
| Pro | Gly | Xaa' | Thr | Cys | Xaa' | Gly | Glu | Ile | Cys | Xaa' | Ala | Tyr | Xaa' | Ala | Ala | Cys | Thr | Gly | Cys | (SEQID NO: 1256) |
| Pro | Gly | Xaa' | Thr | Cys | Xaa' | Gly | Glu | Ile | Cys | Xaa' | Ala | Tyr | Ala | Xaa' | Ala | Cys | Thr | Gly | Cys | (SEQID NO: 1257) |
| Pro | Gly | Xaa' | Thr | Cys | Xaa' | Gly | Glu | Ile | Cys | Xaa' | Ala | Tyr | Ala | Ala | Xaa' | Cys | Thr | Gly | Cys | (SEQID NO: 1258) |
| Pro | Gly | Xaa' | Thr | Cys | Xaa' | Gly | Glu | Ile | Cys | Ala | Xaa' | Tyr | Ala | Ala | Ala | Cys | Thr | Gly | Cys | (SEQID NO: 1259) |
| Pro | Gly | Xaa' | Thr | Cys | Xaa' | Gly | Glu | Ile | Cys | Ala | Xaa' | Tyr | Xaa' | Ala | Ala | Cys | Thr | Gly | Cys | (SEQID NO: 1260) |
| Pro | Gly | Xaa' | Thr | Cys | Xaa' | Gly | Glu | Ile | Cys | Ala | Xaa' | Tyr | Ala | Xaa' | Ala | Cys | Thr | Gly | Cys | (SEQID NO: 1261) |
| Pro | Gly | Xaa' | Thr | Cys | Xaa' | Gly | Glu | Ile | Cys | Ala | Xaa' | Tyr | Ala | Ala | Xaa' | Cys | Thr | Gly | Cys | (SEQID NO: 1262) |

FIG. 2

| Sequence | SEQ ID NO |
|---|---|
| Pro Gly Xaa' Thr Cys Gly Xaa' Xaa' Glu Ile Cys Ala Tyr Ala Ala Cys Thr Gly Xaa' Cys | 1263 |
| Pro Gly Xaa' Thr Cys Gly Xaa' Xaa' Glu Ile Cys Ala Tyr Ala Ala Cys Thr Gly Cys Xaa' | 1264 |
| Pro Gly Xaa' Thr Cys Gly Xaa' Xaa' Xaa' Ile Cys Ala Tyr Ala Ala Cys Thr Gly Cys | 1265 |
| Pro Gly Xaa' Thr Cys Gly Xaa' Glu Xaa' Ile Cys Ala Tyr Ala Ala Cys Thr Gly Cys | 1266 |
| Pro Gly Xaa' Thr Cys Gly Xaa' Glu Ile Xaa' Cys Ala Tyr Ala Ala Cys Thr Gly Gly Cys | 1267 |
| Pro Gly Xaa' Thr Cys Gly Xaa' Glu Ile Cys Xaa' Ala Tyr Ala Ala Cys Thr Gly Gly Cys | 1268 |
| Pro Gly Xaa' Thr Cys Gly Xaa' Glu Ile Cys Ala Xaa' Tyr Ala Ala Cys Thr Gly Gly Cys | 1269 |
| Pro Gly Xaa' Thr Cys Gly Xaa' Glu Ile Cys Ala Tyr Xaa' Ala Ala Cys Thr Gly Gly Cys | 1270 |
| Pro Gly Xaa' Thr Cys Gly Xaa' Glu Ile Cys Ala Tyr Ala Xaa' Ala Cys Thr Gly Gly Cys | 1271 |
| Pro Gly Xaa' Thr Cys Gly Xaa' Glu Ile Cys Ala Tyr Ala Ala Xaa' Cys Thr Gly Gly Cys | 1272 |
| Pro Gly Xaa' Thr Cys Gly Xaa' Glu Ile Cys Ala Tyr Ala Ala Ala Xaa' Thr Gly Gly Cys | 1273 |
| Pro Gly Xaa' Thr Cys Gly Xaa' Glu Ile Cys Ala Tyr Ala Ala Ala Cys Xaa' Gly Gly Cys | 1274 |
| Pro Gly Xaa' Thr Cys Gly Xaa' Glu Ile Cys Ala Tyr Ala Ala Ala Cys Thr Xaa' Gly Cys | 1275 |
| Pro Gly Xaa' Thr Cys Gly Xaa' Glu Ile Cys Ala Tyr Ala Ala Ala Cys Thr Gly Xaa' Cys | 1276 |
| Pro Gly Xaa' Thr Cys Gly Xaa' Glu Ile Cys Ala Tyr Ala Ala Ala Cys Thr Gly Cys Xaa' | 1277 |
| Pro Gly Xaa' Thr Cys Gly Xaa' Glu Ile Xaa' Xaa' Cys Ala Tyr Ala Ala Ala Cys Thr Gly Gly Cys | 1278 |
| Pro Gly Xaa' Thr Cys Gly Xaa' Glu Ile Xaa' Cys Xaa' Ala Tyr Ala Ala Ala Cys Thr Gly Gly Cys | 1279 |
| Pro Gly Xaa' Thr Cys Gly Xaa' Glu Ile Xaa' Cys Ala Xaa' Tyr Ala Ala Ala Cys Thr Gly Gly Cys | 1280 |
| Pro Gly Xaa' Thr Cys Gly Xaa' Glu Ile Xaa' Cys Ala Tyr Xaa' Ala Ala Cys Thr Gly Gly Cys | 1281 |
| Pro Gly Xaa' Thr Cys Gly Xaa' Glu Ile Xaa' Cys Ala Tyr Ala Xaa' Ala Cys Thr Gly Gly Cys | 1282 |
| Pro Gly Xaa' Thr Cys Gly Xaa' Glu Ile Xaa' Cys Ala Tyr Ala Ala Xaa' Cys Thr Gly Gly Cys | 1283 |
| Pro Gly Xaa' Thr Cys Gly Xaa' Glu Ile Xaa' Cys Ala Tyr Ala Ala Ala Xaa' Thr Gly Gly Cys | 1284 |
| Pro Gly Xaa' Thr Cys Gly Xaa' Glu Ile Xaa' Cys Ala Tyr Ala Ala Ala Cys Xaa' Gly Gly Cys | 1285 |
| Pro Gly Xaa' Thr Cys Gly Xaa' Glu Ile Xaa' Cys Ala Tyr Ala Ala Ala Cys Thr Xaa' Gly Cys | 1286 |
| Pro Gly Xaa' Thr Cys Gly Xaa' Glu Ile Xaa' Cys Ala Tyr Ala Ala Ala Cys Thr Gly Xaa' Cys | 1287 |
| Pro Gly Xaa' Thr Cys Gly Xaa' Glu Ile Xaa' Cys Ala Tyr Ala Ala Ala Cys Thr Gly Cys Xaa' | 1288 |
| Pro Gly Xaa' Thr Cys Gly Xaa' Glu Ile Cys Xaa' Xaa' Tyr Ala Ala Ala Cys Thr Gly Gly Cys | 1289 |
| Pro Gly Xaa' Thr Cys Gly Xaa' Glu Ile Cys Xaa' Ala Xaa' Tyr Ala Ala Ala Cys Thr Gly Gly Cys | 1290 |
| Pro Gly Xaa' Thr Cys Gly Xaa' Glu Ile Cys Xaa' Ala Tyr Xaa' Ala Ala Cys Thr Gly Gly Cys | 1291 |
| Pro Gly Xaa' Thr Cys Gly Xaa' Glu Ile Cys Xaa' Ala Tyr Ala Xaa' Ala Cys Thr Gly Gly Cys | 1292 |
| Pro Gly Xaa' Thr Cys Gly Xaa' Glu Ile Cys Xaa' Ala Tyr Ala Ala Xaa' Cys Thr Gly Gly Cys | 1293 |
| Pro Gly Xaa' Thr Cys Gly Xaa' Glu Ile Cys Xaa' Ala Tyr Ala Ala Ala Xaa' Thr Gly Gly Cys | 1294 |
| Pro Gly Xaa' Thr Cys Gly Xaa' Glu Ile Cys Xaa' Ala Tyr Ala Ala Ala Cys Thr Xaa' Gly Cys | 1295 |
| Pro Gly Xaa' Thr Cys Gly Xaa' Glu Ile Cys Xaa' Ala Tyr Ala Ala Ala Cys Thr Gly Xaa' Cys | 1296 |

FIG. 2

| | | | | | | | | | | | | |
|---|---|---|---|---|---|---|---|---|---|---|---|---|
| Pro | Gly | Xaa' | Thr | Cys | Gly | Xaa' | Glu | Ile | Cys | Xaa' | Ala | Tyr | Ala | Ala | Cys | Thr | Gly | Cys | Xaa' | (SEQ ID NO: 1297) |
| Pro | Gly | Xaa' | Thr | Cys | Gly | Xaa' | Glu | Ile | Cys | Ala | Xaa' | Tyr | Ala | Ala | Cys | Thr | Gly | Cys | | (SEQ ID NO: 1298) |
| Pro | Gly | Xaa' | Thr | Cys | Gly | Xaa' | Glu | Ile | Cys | Ala | Xaa' | Xaa' | Tyr | Ala | Ala | Cys | Thr | Gly | Cys | (SEQ ID NO: 1299) |
| Pro | Gly | Xaa' | Thr | Cys | Gly | Xaa' | Glu | Ile | Cys | Ala | Xaa' | Xaa' | Tyr | Ala | Ala | Cys | Thr | Gly | Cys | (SEQ ID NO: 1300) |
| Pro | Gly | Xaa' | Thr | Cys | Gly | Xaa' | Glu | Ile | Cys | Ala | Xaa' | Xaa' | Tyr | Ala | Ala | Xaa' | Cys | Thr | Gly | Cys | (SEQ ID NO: 1301) |
| Pro | Gly | Xaa' | Thr | Cys | Gly | Xaa' | Glu | Ile | Cys | Ala | Xaa' | Xaa' | Tyr | Ala | Ala | Xaa' | Cys | Thr | Gly | Cys | (SEQ ID NO: 1302) |
| Pro | Gly | Xaa' | Thr | Cys | Gly | Xaa' | Glu | Ile | Cys | Ala | Xaa' | Xaa' | Tyr | Ala | Ala | Xaa' | Cys | Thr | Gly | Cys | (SEQ ID NO: 1303) |
| Pro | Gly | Xaa' | Thr | Cys | Gly | Xaa' | Glu | Ile | Cys | Ala | Xaa' | Xaa' | Tyr | Ala | Ala | Xaa' | Cys | Thr | Gly | Cys | (SEQ ID NO: 1304) |
| Pro | Gly | Xaa' | Thr | Cys | Gly | Xaa' | Glu | Ile | Cys | Ala | Xaa' | Tyr | Ala | Ala | Cys | Thr | Xaa' | Gly | Cys | (SEQ ID NO: 1305) |
| Pro | Gly | Xaa' | Thr | Cys | Gly | Xaa' | Glu | Ile | Cys | Ala | Xaa' | Tyr | Ala | Ala | Cys | Thr | Gly | Xaa' | Cys | (SEQ ID NO: 1306) |
| Pro | Gly | Xaa' | Thr | Cys | Gly | Xaa' | Glu | Ile | Cys | Ala | Xaa' | Tyr | Ala | Ala | Cys | Thr | Gly | Cys | Xaa' | (SEQ ID NO: 1307) |
| Pro | Gly | Xaa' | Thr | Cys | Gly | Xaa' | Glu | Ile | Cys | Ala | Tyr | Xaa' | Ala | Ala | Xaa' | Cys | Thr | Gly | Cys | (SEQ ID NO: 1308) |
| Pro | Gly | Xaa' | Thr | Cys | Gly | Xaa' | Glu | Ile | Cys | Ala | Tyr | Xaa' | Ala | Ala | Xaa' | Cys | Thr | Gly | Cys | (SEQ ID NO: 1309) |
| Pro | Gly | Xaa' | Thr | Cys | Gly | Xaa' | Glu | Ile | Cys | Ala | Tyr | Xaa' | Ala | Ala | Xaa' | Cys | Thr | Gly | Cys | (SEQ ID NO: 1310) |
| Pro | Gly | Xaa' | Thr | Cys | Gly | Xaa' | Glu | Ile | Cys | Ala | Tyr | Xaa' | Ala | Ala | Xaa' | Cys | Thr | Gly | Cys | (SEQ ID NO: 1311) |
| Pro | Gly | Xaa' | Thr | Cys | Gly | Xaa' | Glu | Ile | Cys | Ala | Tyr | Xaa' | Ala | Ala | Xaa' | Cys | Thr | Gly | Cys | (SEQ ID NO: 1312) |
| Pro | Gly | Xaa' | Thr | Cys | Gly | Xaa' | Glu | Ile | Cys | Ala | Tyr | Xaa' | Ala | Ala | Xaa' | Cys | Thr | Xaa' | Gly | Cys | (SEQ ID NO: 1313) |
| Pro | Gly | Xaa' | Thr | Cys | Gly | Xaa' | Glu | Ile | Cys | Ala | Tyr | Xaa' | Ala | Ala | Xaa' | Cys | Thr | Gly | Xaa' | Cys | (SEQ ID NO: 1314) |
| Pro | Gly | Xaa' | Thr | Cys | Gly | Xaa' | Glu | Ile | Cys | Ala | Tyr | Xaa' | Ala | Ala | Xaa' | Cys | Thr | Gly | Cys | Xaa' | (SEQ ID NO: 1315) |
| Pro | Gly | Xaa' | Thr | Cys | Gly | Xaa' | Glu | Ile | Cys | Ala | Tyr | Ala | Xaa' | Ala | Xaa' | Cys | Thr | Gly | Cys | (SEQ ID NO: 1316) |
| Pro | Gly | Xaa' | Thr | Cys | Gly | Xaa' | Glu | Ile | Cys | Ala | Tyr | Ala | Xaa' | Ala | Xaa' | Cys | Thr | Gly | Cys | (SEQ ID NO: 1317) |
| Pro | Gly | Xaa' | Thr | Cys | Gly | Xaa' | Glu | Ile | Cys | Ala | Tyr | Ala | Xaa' | Ala | Xaa' | Cys | Thr | Gly | Cys | (SEQ ID NO: 1318) |
| Pro | Gly | Xaa' | Thr | Cys | Gly | Xaa' | Glu | Ile | Cys | Ala | Tyr | Ala | Xaa' | Ala | Xaa' | Cys | Thr | Gly | Cys | (SEQ ID NO: 1319) |
| Pro | Gly | Xaa' | Thr | Cys | Gly | Xaa' | Glu | Ile | Cys | Ala | Tyr | Ala | Xaa' | Ala | Xaa' | Cys | Thr | Gly | Cys | (SEQ ID NO: 1320) |
| Pro | Gly | Xaa' | Thr | Cys | Gly | Xaa' | Glu | Ile | Cys | Ala | Tyr | Ala | Xaa' | Ala | Xaa' | Cys | Thr | Gly | Cys | (SEQ ID NO: 1321) |
| Pro | Gly | Xaa' | Thr | Cys | Gly | Xaa' | Glu | Ile | Cys | Ala | Tyr | Ala | Xaa' | Ala | Xaa' | Cys | Thr | Gly | Cys | Xaa' | (SEQ ID NO: 1322) |
| Pro | Gly | Xaa' | Thr | Cys | Gly | Xaa' | Glu | Ile | Cys | Ala | Tyr | Ala | Ala | Xaa' | Xaa' | Cys | Thr | Gly | Cys | (SEQ ID NO: 1323) |
| Pro | Gly | Xaa' | Thr | Cys | Gly | Xaa' | Glu | Ile | Cys | Ala | Tyr | Ala | Ala | Xaa' | Cys | Xaa' | Thr | Gly | Cys | (SEQ ID NO: 1324) |
| Pro | Gly | Xaa' | Thr | Cys | Gly | Xaa' | Glu | Ile | Cys | Ala | Tyr | Ala | Ala | Xaa' | Cys | Thr | Xaa' | Gly | Cys | (SEQ ID NO: 1325) |
| Pro | Gly | Xaa' | Thr | Cys | Gly | Xaa' | Glu | Ile | Cys | Ala | Tyr | Ala | Ala | Xaa' | Cys | Thr | Gly | Xaa' | Cys | (SEQ ID NO: 1326) |
| Pro | Gly | Xaa' | Thr | Cys | Gly | Xaa' | Glu | Ile | Cys | Ala | Tyr | Ala | Ala | Xaa' | Cys | Thr | Gly | Cys | Xaa' | (SEQ ID NO: 1327) |
| Pro | Gly | Xaa' | Thr | Cys | Gly | Xaa' | Glu | Ile | Cys | Ala | Tyr | Ala | Ala | Cys | Xaa' | Thr | Gly | Cys | | (SEQ ID NO: 1328) |
| Pro | Gly | Xaa' | Thr | Cys | Gly | Xaa' | Glu | Ile | Cys | Ala | Tyr | Ala | Ala | Cys | Xaa' | Xaa' | Thr | Gly | Cys | (SEQ ID NO: 1329) |
| Pro | Gly | Xaa' | Thr | Cys | Gly | Xaa' | Glu | Ile | Cys | Ala | Tyr | Ala | Ala | Cys | Xaa' | Thr | Xaa' | Gly | Cys | (SEQ ID NO: 1330) |

FIG. 2

```
Pro Gly Xaa' Thr Cys Gly Gly Xaa' Glu Ile Cys Ala Tyr Ala Ala Cys Xaa' Thr Gly Xaa' Cys      (SEQ ID NO: 1331)
Pro Gly Xaa' Thr Cys Gly Gly Xaa' Glu Ile Cys Ala Tyr Ala Ala Cys Xaa' Thr Gly Cys Xaa'      (SEQ ID NO: 1332)
Pro Gly Xaa' Thr Cys Gly Gly Xaa' Glu Ile Cys Ala Tyr Ala Ala Cys Thr Gly Xaa' Gly Cys       (SEQ ID NO: 1333)
Pro Gly Xaa' Thr Cys Gly Gly Xaa' Glu Ile Cys Ala Tyr Ala Ala Cys Thr Xaa' Xaa' Gly Cys      (SEQ ID NO: 1334)
Pro Gly Xaa' Thr Cys Gly Gly Xaa' Glu Ile Cys Ala Tyr Ala Ala Cys Thr Xaa' Gly Xaa' Cys      (SEQ ID NO: 1335)
Pro Gly Xaa' Thr Cys Gly Gly Xaa' Glu Ile Cys Ala Tyr Ala Ala Cys Thr Xaa' Gly Cys Xaa'      (SEQ ID NO: 1336)
Pro Gly Xaa' Thr Cys Gly Gly Xaa' Glu Ile Cys Ala Tyr Ala Ala Cys Thr Gly Xaa' Cys Xaa'      (SEQ ID NO: 1337)
Pro Gly Xaa' Thr Cys Gly Gly Xaa' Glu Ile Cys Ala Tyr Ala Ala Cys Xaa' Thr Gly Xaa' Cys      (SEQ ID NO: 1338)
Pro Gly Xaa' Thr Cys Gly Gly Xaa' Glu Ile Cys Ala Tyr Ala Ala Cys Xaa' Thr Gly Cys Xaa'      (SEQ ID NO: 1339)
Pro Gly Xaa' Thr Cys Gly Gly Xaa' Glu Ile Cys Ala Tyr Ala Ala Cys Xaa' Thr Xaa' Gly Cys      (SEQ ID NO: 1340)
Pro Gly Xaa' Thr Cys Gly Gly Xaa' Glu Ile Cys Ala Tyr Ala Ala Cys Xaa' Xaa' Thr Gly Cys      (SEQ ID NO: 1341)
Pro Gly Xaa' Thr Cys Gly Gly Xaa' Glu Ile Cys Ala Tyr Ala Ala Cys Xaa' Xaa' Cys Thr Gly Cys  (SEQ ID NO: 1342)
Pro Gly Xaa' Thr Cys Gly Gly Glu Xaa' Ile Cys Ala Tyr Ala Ala Cys Thr Gly Cys                (SEQ ID NO: 1343)
Pro Gly Xaa' Thr Cys Gly Gly Glu Xaa' Xaa' Ile Cys Ala Tyr Ala Ala Cys Thr Gly Cys           (SEQ ID NO: 1344)
Pro Gly Xaa' Thr Cys Gly Gly Glu Xaa' Xaa' Cys Ala Tyr Ala Ala Cys Thr Gly Cys               (SEQ ID NO: 1345)
Pro Gly Xaa' Thr Cys Gly Gly Glu Xaa' Ile Xaa' Ala Tyr Ala Ala Cys Thr Gly Cys               (SEQ ID NO: 1346)
Pro Gly Xaa' Thr Cys Gly Gly Glu Xaa' Ile Cys Xaa' Ala Tyr Xaa' Ala Ala Cys Thr Gly Cys      (SEQ ID NO: 1347)
Pro Gly Xaa' Thr Cys Gly Gly Glu Xaa' Ile Cys Ala Xaa' Tyr Ala Ala Cys Thr Gly Cys           (SEQ ID NO: 1348)
Pro Gly Xaa' Thr Cys Gly Gly Glu Xaa' Ile Cys Ala Tyr Xaa' Ala Ala Cys Thr Gly Cys           (SEQ ID NO: 1349)
Pro Gly Xaa' Thr Cys Gly Gly Glu Xaa' Ile Cys Ala Tyr Ala Xaa' Ala Cys Thr Gly Cys           (SEQ ID NO: 1350)
Pro Gly Xaa' Thr Cys Gly Gly Glu Xaa' Ile Cys Ala Tyr Ala Ala Xaa' Cys Thr Gly Cys           (SEQ ID NO: 1351)
Pro Gly Xaa' Thr Cys Gly Gly Glu Xaa' Ile Cys Ala Tyr Ala Ala Cys Xaa' Thr Gly Cys           (SEQ ID NO: 1352)
Pro Gly Xaa' Thr Cys Gly Gly Glu Xaa' Ile Cys Ala Tyr Ala Ala Cys Thr Xaa' Gly Cys           (SEQ ID NO: 1353)
Pro Gly Xaa' Thr Cys Gly Gly Glu Xaa' Ile Cys Ala Tyr Ala Ala Cys Thr Gly Xaa' Cys           (SEQ ID NO: 1354)
Pro Gly Xaa' Thr Cys Gly Gly Glu Xaa' Ile Cys Ala Tyr Ala Ala Cys Thr Gly Cys Xaa'           (SEQ ID NO: 1355)
Pro Gly Xaa' Thr Cys Gly Gly Glu Ile Xaa' Cys Ala Tyr Ala Ala Cys Thr Gly Cys                (SEQ ID NO: 1356)
Pro Gly Xaa' Thr Cys Gly Gly Glu Ile Xaa' Ala Tyr Ala Ala Cys Thr Gly Cys                    (SEQ ID NO: 1357)
Pro Gly Xaa' Thr Cys Gly Gly Glu Ile Cys Xaa' Ala Tyr Ala Ala Cys Thr Gly Cys                (SEQ ID NO: 1358)
Pro Gly Xaa' Thr Cys Gly Gly Glu Ile Cys Xaa' Ala Tyr Ala Ala Cys Thr Gly Cys                (SEQ ID NO: 1359)
Pro Gly Xaa' Thr Cys Gly Gly Glu Ile Cys Ala Xaa' Tyr Ala Ala Cys Thr Gly Cys                (SEQ ID NO: 1360)
Pro Gly Xaa' Thr Cys Gly Gly Glu Ile Cys Ala Tyr Xaa' Ala Ala Cys Thr Gly Cys                (SEQ ID NO: 1361)
Pro Gly Xaa' Thr Cys Gly Gly Glu Ile Cys Ala Tyr Ala Xaa' Ala Cys Thr Gly Cys                (SEQ ID NO: 1362)
Pro Gly Xaa' Thr Cys Gly Gly Glu Ile Cys Ala Tyr Ala Ala Xaa' Cys Thr Gly Cys                (SEQ ID NO: 1363)
Pro Gly Xaa' Thr Cys Gly Gly Glu Ile Cys Ala Tyr Ala Ala Cys Thr Xaa' Gly Cys                (SEQ ID NO: 1364)
```

FIG. 2

| | | | | | | | | | | | | | | |
|---|---|---|---|---|---|---|---|---|---|---|---|---|---|---|
|Pro|Gly|Xaa'|Thr|Cys|Gly|Glu|Xaa'|Ile|Xaa'|Cys|Ala|Tyr|Ala|Ala|Cys|Thr|Gly|Cys|Xaa'|(SEQ ID NO: 1365)|
|Pro|Gly|Xaa'|Thr|Cys|Gly|Glu|Xaa'|Ile|Cys|Xaa'|Ala|Tyr|Ala|Ala|Cys|Thr|Gly|Cys|    |(SEQ ID NO: 1366)|
|Pro|Gly|Xaa'|Thr|Cys|Gly|Glu|Xaa'|Ile|Cys|Xaa'|Ala|Tyr|Ala|Ala|Cys|Thr|Gly|Cys|Cys |(SEQ ID NO: 1367)|
|Pro|Gly|Xaa'|Thr|Cys|Gly|Glu|Xaa'|Ile|Cys|Xaa'|Ala|Tyr|Ala|Ala|Xaa'|Thr|Gly|Cys|Cys |(SEQ ID NO: 1368)|
|Pro|Gly|Xaa'|Thr|Cys|Gly|Glu|Xaa'|Ile|Cys|Xaa'|Ala|Tyr|Ala|Xaa'|Ala|Thr|Gly|Cys|Cys |(SEQ ID NO: 1369)|
|Pro|Gly|Xaa'|Thr|Cys|Gly|Glu|Xaa'|Ile|Cys|Xaa'|Ala|Tyr|Xaa'|Ala|Ala|Thr|Gly|Cys|Cys |(SEQ ID NO: 1370)|
|Pro|Gly|Xaa'|Thr|Cys|Gly|Glu|Xaa'|Ile|Cys|Xaa'|Ala|Xaa'|Ala|Ala|Cys|Thr|Gly|Cys|Cys |(SEQ ID NO: 1371)|
|Pro|Gly|Xaa'|Thr|Cys|Gly|Glu|Xaa'|Ile|Cys|Xaa'|Ala|Tyr|Ala|Ala|Xaa'|Thr|Gly|Cys|Cys |(SEQ ID NO: 1372)|
|Pro|Gly|Xaa'|Thr|Cys|Gly|Glu|Xaa'|Ile|Cys|Xaa'|Ala|Tyr|Ala|Ala|Cys|Xaa'|Gly|Cys|Cys |(SEQ ID NO: 1373)|
|Pro|Gly|Xaa'|Thr|Cys|Gly|Glu|Xaa'|Ile|Cys|Xaa'|Ala|Tyr|Ala|Ala|Cys|Thr|Gly|Xaa'|Cys |(SEQ ID NO: 1374)|
|Pro|Gly|Xaa'|Thr|Cys|Gly|Glu|Xaa'|Ile|Cys|Xaa'|Ala|Tyr|Ala|Ala|Cys|Thr|Gly|Cys|Xaa' |(SEQ ID NO: 1375)|
|Pro|Gly|Xaa'|Thr|Cys|Gly|Glu|Xaa'|Ile|Cys|Ala|Xaa'|Xaa'|Ala|Ala|Cys|Thr|Gly|Cys|     |(SEQ ID NO: 1376)|
|Pro|Gly|Xaa'|Thr|Cys|Gly|Glu|Xaa'|Ile|Cys|Ala|Xaa'|Xaa'|Ala|Ala|Cys|Thr|Gly|Cys|Cys  |(SEQ ID NO: 1377)|
|Pro|Gly|Xaa'|Thr|Cys|Gly|Glu|Xaa'|Ile|Cys|Ala|Xaa'|Tyr|Ala|Ala|Ala|Cys|Thr|Gly|Cys   |(SEQ ID NO: 1378)|
|Pro|Gly|Xaa'|Thr|Cys|Gly|Glu|Xaa'|Ile|Cys|Ala|Xaa'|Tyr|Ala|Xaa'|Ala|Cys|Thr|Gly|Cys  |(SEQ ID NO: 1379)|
|Pro|Gly|Xaa'|Thr|Cys|Gly|Glu|Xaa'|Ile|Cys|Ala|Xaa'|Tyr|Xaa'|Ala|Ala|Cys|Thr|Gly|Cys  |(SEQ ID NO: 1380)|
|Pro|Gly|Xaa'|Thr|Cys|Gly|Glu|Xaa'|Ile|Cys|Ala|Xaa'|Xaa'|Ala|Ala|Cys|Thr|Gly|Cys|Cys  |(SEQ ID NO: 1381)|
|Pro|Gly|Xaa'|Thr|Cys|Gly|Glu|Xaa'|Ile|Cys|Ala|Xaa'|Tyr|Xaa'|Ala|Cys|Thr|Gly|Cys|     |(SEQ ID NO: 1382)|
|Pro|Gly|Xaa'|Thr|Cys|Gly|Glu|Xaa'|Ile|Cys|Ala|Xaa'|Tyr|Ala|Ala|Xaa'|Gly|Cys|Cys|     |(SEQ ID NO: 1383)|
|Pro|Gly|Xaa'|Thr|Cys|Gly|Glu|Xaa'|Ile|Cys|Ala|Xaa'|Tyr|Ala|Ala|Cys|Thr|Gly|Cys|Xaa'  |(SEQ ID NO: 1384)|
|Pro|Gly|Xaa'|Thr|Cys|Gly|Glu|Xaa'|Ile|Cys|Ala|Xaa'|Tyr|Ala|Ala|Cys|Thr|Gly|Cys|      |(SEQ ID NO: 1385)|
|Pro|Gly|Xaa'|Thr|Cys|Gly|Glu|Xaa'|Ile|Cys|Ala|Tyr|Xaa'|Xaa'|Ala|Ala|Cys|Thr|Gly|Cys  |(SEQ ID NO: 1386)|
|Pro|Gly|Xaa'|Thr|Cys|Gly|Glu|Xaa'|Ile|Cys|Ala|Tyr|Xaa'|Ala|Xaa'|Ala|Cys|Thr|Gly|Cys  |(SEQ ID NO: 1387)|
|Pro|Gly|Xaa'|Thr|Cys|Gly|Glu|Xaa'|Ile|Cys|Ala|Tyr|Xaa'|Ala|Ala|Xaa'|Cys|Thr|Gly|Cys  |(SEQ ID NO: 1388)|
|Pro|Gly|Xaa'|Thr|Cys|Gly|Glu|Xaa'|Ile|Cys|Ala|Tyr|Xaa'|Ala|Ala|Cys|Xaa'|Gly|Cys|     |(SEQ ID NO: 1389)|
|Pro|Gly|Xaa'|Thr|Cys|Gly|Glu|Xaa'|Ile|Cys|Ala|Tyr|Xaa'|Ala|Ala|Cys|Thr|Xaa'|Cys|     |(SEQ ID NO: 1390)|
|Pro|Gly|Xaa'|Thr|Cys|Gly|Glu|Xaa'|Ile|Cys|Ala|Tyr|Xaa'|Ala|Ala|Cys|Thr|Gly|Xaa'|     |(SEQ ID NO: 1391)|
|Pro|Gly|Xaa'|Thr|Cys|Gly|Glu|Xaa'|Ile|Cys|Ala|Tyr|Xaa'|Ala|Ala|Cys|Thr|Gly|Cys|Xaa'  |(SEQ ID NO: 1392)|
|Pro|Gly|Xaa'|Thr|Cys|Gly|Glu|Xaa'|Ile|Cys|Ala|Tyr|Ala|Xaa'|Xaa'|Ala|Cys|Thr|Gly|Cys  |(SEQ ID NO: 1393)|
|Pro|Gly|Xaa'|Thr|Cys|Gly|Glu|Xaa'|Ile|Cys|Ala|Tyr|Ala|Xaa'|Ala|Xaa'|Cys|Thr|Gly|Cys  |(SEQ ID NO: 1394)|
|Pro|Gly|Xaa'|Thr|Cys|Gly|Glu|Xaa'|Ile|Cys|Ala|Tyr|Ala|Xaa'|Ala|Cys|Xaa'|Gly|Cys|     |(SEQ ID NO: 1395)|
|Pro|Gly|Xaa'|Thr|Cys|Gly|Glu|Xaa'|Ile|Cys|Ala|Tyr|Ala|Xaa'|Ala|Cys|Thr|Xaa'|Cys|     |(SEQ ID NO: 1396)|
|Pro|Gly|Xaa'|Thr|Cys|Gly|Glu|Xaa'|Ile|Cys|Ala|Tyr|Ala|Xaa'|Ala|Cys|Thr|Gly|Cys|      |(SEQ ID NO: 1397)|
|Pro|Gly|Xaa'|Thr|Cys|Gly|Glu|Xaa'|Ile|Cys|Ala|Tyr|Ala|Xaa'|Ala|Cys|Thr|Gly|Xaa'|Cys  |(SEQ ID NO: 1398)|

FIG. 2

```
Pro Gly Xaa' Thr Cys Gly Glu Xaa' Ile Cys Ala Tyr Ala Xaa' Ala Cys Thr Gly Cys Xaa'   (SEQ ID NO: 1399)
Pro Gly Xaa' Thr Cys Gly Glu Xaa' Ile Cys Ala Tyr Ala Ala Xaa' Cys Thr Gly Cys         (SEQ ID NO: 1400)
Pro Gly Xaa' Thr Cys Gly Glu Xaa' Ile Cys Ala Tyr Ala Ala Xaa' Cys Thr Gly Cys         (SEQ ID NO: 1401)
Pro Gly Xaa' Thr Cys Gly Glu Xaa' Ile Cys Ala Tyr Ala Ala Ala Xaa' Cys Thr Gly Cys     (SEQ ID NO: 1402)
Pro Gly Xaa' Thr Cys Gly Glu Xaa' Ile Cys Ala Tyr Ala Ala Ala Xaa' Cys Thr Gly Cys     (SEQ ID NO: 1403)
Pro Gly Xaa' Thr Cys Gly Glu Xaa' Ile Cys Ala Tyr Ala Ala Ala Xaa' Cys Thr Gly Xaa' Cys (SEQ ID NO: 1404)
Pro Gly Xaa' Thr Cys Gly Glu Xaa' Ile Cys Ala Tyr Ala Ala Ala Xaa' Cys Thr Gly Cys Xaa' (SEQ ID NO: 1405)
Pro Gly Xaa' Thr Cys Gly Glu Xaa' Ile Cys Ala Tyr Ala Ala Ala Xaa' Cys Xaa' Thr Gly Cys (SEQ ID NO: 1406)
Pro Gly Xaa' Thr Cys Gly Glu Xaa' Ile Cys Ala Tyr Ala Ala Ala Cys Xaa' Thr Gly Cys     (SEQ ID NO: 1407)
Pro Gly Xaa' Thr Cys Gly Glu Xaa' Ile Cys Ala Tyr Ala Ala Ala Cys Xaa' Xaa' Thr Gly Cys (SEQ ID NO: 1408)
Pro Gly Xaa' Thr Cys Gly Glu Xaa' Ile Cys Ala Tyr Ala Ala Ala Cys Xaa' Thr Gly Xaa' Cys (SEQ ID NO: 1409)
Pro Gly Xaa' Thr Cys Gly Glu Xaa' Ile Cys Ala Tyr Ala Ala Ala Cys Xaa' Thr Gly Cys Xaa' (SEQ ID NO: 1410)
Pro Gly Xaa' Thr Cys Gly Glu Xaa' Ile Cys Ala Tyr Ala Ala Ala Cys Thr Xaa' Gly Cys     (SEQ ID NO: 1411)
Pro Gly Xaa' Thr Cys Gly Glu Xaa' Ile Cys Ala Tyr Ala Ala Ala Cys Thr Xaa' Xaa' Gly Cys (SEQ ID NO: 1412)
Pro Gly Xaa' Thr Cys Gly Glu Xaa' Ile Cys Ala Tyr Ala Ala Ala Cys Thr Xaa' Gly Xaa' Cys (SEQ ID NO: 1413)
Pro Gly Xaa' Thr Cys Gly Glu Xaa' Ile Cys Ala Tyr Ala Ala Ala Cys Thr Xaa' Gly Cys Xaa' (SEQ ID NO: 1414)
Pro Gly Xaa' Thr Cys Gly Glu Xaa' Ile Cys Ala Tyr Ala Ala Ala Cys Thr Gly Xaa' Cys     (SEQ ID NO: 1415)
Pro Gly Xaa' Thr Cys Gly Glu Xaa' Ile Cys Ala Tyr Ala Ala Ala Cys Thr Gly Xaa' Xaa' Cys (SEQ ID NO: 1416)
Pro Gly Xaa' Thr Cys Gly Glu Xaa' Ile Cys Ala Tyr Ala Ala Ala Cys Thr Gly Xaa' Cys Xaa' (SEQ ID NO: 1417)
Pro Gly Xaa' Thr Cys Gly Glu Xaa' Ile Cys Ala Tyr Ala Ala Ala Cys Thr Gly Cys Xaa'     (SEQ ID NO: 1418)
Pro Gly Xaa' Thr Cys Gly Glu Ile Xaa' Cys Ala Tyr Ala Ala Ala Cys Thr Gly Cys Xaa'     (SEQ ID NO: 1419)
Pro Gly Xaa' Thr Cys Gly Glu Ile Xaa' Cys Ala Tyr Ala Ala Ala Cys Thr Gly Cys          (SEQ ID NO: 1420)
Pro Gly Xaa' Thr Cys Gly Glu Ile Ile Xaa' Cys Ala Tyr Ala Ala Ala Cys Thr Gly Cys      (SEQ ID NO: 1421)
Pro Gly Xaa' Thr Cys Gly Glu Ile Ile Xaa' Xaa' Cys Ala Tyr Ala Ala Ala Cys Thr Gly Cys (SEQ ID NO: 1422)
Pro Gly Xaa' Thr Cys Gly Glu Ile Ile Xaa' Cys Xaa' Ala Tyr Ala Ala Ala Cys Thr Gly Cys (SEQ ID NO: 1423)
Pro Gly Xaa' Thr Cys Gly Glu Ile Ile Xaa' Cys Ala Xaa' Tyr Ala Ala Ala Cys Thr Gly Cys (SEQ ID NO: 1424)
Pro Gly Xaa' Thr Cys Gly Glu Ile Ile Xaa' Cys Ala Tyr Xaa' Ala Ala Ala Cys Thr Gly Cys (SEQ ID NO: 1425)
Pro Gly Xaa' Thr Cys Gly Glu Ile Ile Xaa' Cys Ala Tyr Ala Xaa' Ala Ala Cys Thr Gly Cys (SEQ ID NO: 1426)
Pro Gly Xaa' Thr Cys Gly Glu Ile Ile Xaa' Cys Ala Tyr Ala Ala Xaa' Ala Cys Thr Gly Cys (SEQ ID NO: 1427)
Pro Gly Xaa' Thr Cys Gly Glu Ile Ile Xaa' Cys Ala Tyr Ala Ala Ala Xaa' Cys Thr Gly Cys (SEQ ID NO: 1428)
Pro Gly Xaa' Thr Cys Gly Glu Ile Ile Xaa' Cys Ala Tyr Ala Ala Ala Cys Thr Gly Cys     (SEQ ID NO: 1429)
Pro Gly Xaa' Thr Cys Gly Glu Ile Ile Xaa' Cys Ala Tyr Ala Ala Ala Cys Thr Gly Xaa' Cys (SEQ ID NO: 1430)
Pro Gly Xaa' Thr Cys Gly Glu Ile Ile Xaa' Cys Ala Tyr Ala Ala Ala Cys Thr Gly Cys Xaa' (SEQ ID NO: 1431)
Pro Gly Xaa' Thr Cys Gly Ile Ile Xaa' Cys Xaa' Ala Tyr Ala Ala Ala Cys Thr Gly Cys    (SEQ ID NO: 1432)
```

FIG. 2

| Sequence | SEQ ID NO |
|---|---|
| Pro Gly Xaa' Thr Cys Gly Glu Ile Xaa' Cys Xaa' Xaa' Ala Tyr Ala Ala Cys Thr Gly Cys | (SEQ ID NO: 1433) |
| Pro Gly Xaa' Thr Cys Gly Glu Ile Xaa' Cys Xaa' Xaa' Ala Xaa' Tyr Ala Ala Cys Thr Gly Cys | (SEQ ID NO: 1434) |
| Pro Gly Xaa' Thr Cys Gly Glu Ile Xaa' Cys Xaa' Ala Tyr Xaa' Ala Ala Cys Thr Gly Cys | (SEQ ID NO: 1435) |
| Pro Gly Xaa' Thr Cys Gly Glu Ile Xaa' Cys Xaa' Ala Tyr Ala Xaa' Ala Cys Thr Gly Cys | (SEQ ID NO: 1436) |
| Pro Gly Xaa' Thr Cys Gly Glu Ile Xaa' Cys Xaa' Ala Tyr Ala Ala Xaa' Cys Thr Gly Cys | (SEQ ID NO: 1437) |
| Pro Gly Xaa' Thr Cys Gly Glu Ile Xaa' Cys Xaa' Ala Tyr Ala Ala Cys Xaa' Thr Gly Cys | (SEQ ID NO: 1438) |
| Pro Gly Xaa' Thr Cys Gly Glu Ile Xaa' Cys Xaa' Ala Tyr Ala Ala Cys Thr Xaa' Gly Cys | (SEQ ID NO: 1439) |
| Pro Gly Xaa' Thr Cys Gly Glu Ile Xaa' Cys Xaa' Ala Tyr Ala Ala Cys Thr Gly Xaa' Cys | (SEQ ID NO: 1440) |
| Pro Gly Xaa' Thr Cys Gly Glu Ile Xaa' Cys Xaa' Ala Tyr Ala Ala Cys Thr Gly Cys Xaa' | (SEQ ID NO: 1441) |
| Pro Gly Xaa' Thr Cys Gly Glu Ile Xaa' Cys Ala Xaa' Tyr Ala Ala Cys Thr Gly Cys | (SEQ ID NO: 1442) |
| Pro Gly Xaa' Thr Cys Gly Glu Ile Xaa' Cys Ala Xaa' Tyr Ala Ala Cys Thr Gly Cys | (SEQ ID NO: 1443) |
| Pro Gly Xaa' Thr Cys Gly Glu Ile Xaa' Cys Ala Xaa' Tyr Xaa' Ala Ala Cys Thr Gly Cys | (SEQ ID NO: 1444) |
| Pro Gly Xaa' Thr Cys Gly Glu Ile Xaa' Cys Ala Xaa' Tyr Ala Xaa' Ala Cys Thr Gly Cys | (SEQ ID NO: 1445) |
| Pro Gly Xaa' Thr Cys Gly Glu Ile Xaa' Cys Ala Xaa' Tyr Ala Ala Xaa' Cys Thr Gly Cys | (SEQ ID NO: 1446) |
| Pro Gly Xaa' Thr Cys Gly Glu Ile Xaa' Cys Ala Xaa' Tyr Ala Ala Cys Xaa' Thr Gly Cys | (SEQ ID NO: 1447) |
| Pro Gly Xaa' Thr Cys Gly Glu Ile Xaa' Cys Ala Xaa' Tyr Ala Ala Cys Thr Xaa' Gly Cys | (SEQ ID NO: 1448) |
| Pro Gly Xaa' Thr Cys Gly Glu Ile Xaa' Cys Ala Xaa' Tyr Ala Ala Cys Thr Gly Xaa' Cys | (SEQ ID NO: 1449) |
| Pro Gly Xaa' Thr Cys Gly Glu Ile Xaa' Cys Ala Xaa' Tyr Ala Ala Cys Thr Gly Cys Xaa' | (SEQ ID NO: 1450) |
| Pro Gly Xaa' Thr Cys Gly Glu Ile Xaa' Cys Ala Tyr Xaa' Ala Ala Cys Thr Gly Cys | (SEQ ID NO: 1451) |
| Pro Gly Xaa' Thr Cys Gly Glu Ile Xaa' Cys Ala Xaa' Tyr Ala Ala Xaa' Ala Cys Thr Gly Cys | (SEQ ID NO: 1452) |
| Pro Gly Xaa' Thr Cys Gly Glu Ile Xaa' Cys Ala Xaa' Tyr Ala Ala Ala Xaa' Cys Thr Gly Cys | (SEQ ID NO: 1453) |
| Pro Gly Xaa' Thr Cys Gly Glu Ile Xaa' Cys Ala Xaa' Tyr Ala Ala Xaa' Cys Xaa' Thr Gly Cys | (SEQ ID NO: 1454) |
| Pro Gly Xaa' Thr Cys Gly Glu Ile Xaa' Cys Ala Xaa' Tyr Ala Ala Xaa' Cys Thr Xaa' Gly Cys | (SEQ ID NO: 1455) |
| Pro Gly Xaa' Thr Cys Gly Glu Ile Xaa' Cys Ala Xaa' Tyr Ala Ala Xaa' Cys Thr Gly Xaa' Cys | (SEQ ID NO: 1456) |
| Pro Gly Xaa' Thr Cys Gly Glu Ile Xaa' Cys Ala Xaa' Tyr Ala Ala Xaa' Cys Thr Gly Cys Xaa' | (SEQ ID NO: 1457) |
| Pro Gly Xaa' Thr Cys Gly Glu Ile Xaa' Cys Ala Xaa' Tyr Ala Ala Cys Thr Gly Cys | (SEQ ID NO: 1458) |
| Pro Gly Xaa' Thr Cys Gly Glu Ile Xaa' Cys Ala Xaa' Tyr Ala Ala Cys Thr Gly Cys | (SEQ ID NO: 1459) |
| Pro Gly Xaa' Thr Cys Gly Glu Ile Xaa' Cys Ala Xaa' Tyr Ala Ala Xaa' Cys Thr Gly Cys | (SEQ ID NO: 1460) |
| Pro Gly Xaa' Thr Cys Gly Glu Ile Xaa' Cys Ala Xaa' Tyr Ala Xaa' Ala Cys Thr Gly Cys | (SEQ ID NO: 1461) |
| Pro Gly Xaa' Thr Cys Gly Glu Ile Xaa' Cys Ala Xaa' Tyr Ala Ala Xaa' Cys Thr Gly Cys | (SEQ ID NO: 1462) |
| Pro Gly Xaa' Thr Cys Gly Glu Ile Xaa' Cys Ala Xaa' Tyr Ala Ala Cys Xaa' Thr Gly Cys | (SEQ ID NO: 1463) |
| Pro Gly Xaa' Thr Cys Gly Glu Ile Xaa' Cys Ala Xaa' Tyr Ala Ala Cys Thr Xaa' Gly Cys | (SEQ ID NO: 1464) |
| Pro Gly Xaa' Thr Cys Gly Glu Ile Xaa' Cys Ala Xaa' Tyr Ala Ala Cys Thr Gly Xaa' Cys | (SEQ ID NO: 1465) |
| Pro Gly Xaa' Thr Cys Gly Glu Ile Xaa' Cys Ala Tyr Ala Ala Xaa' Cys Thr Gly Cys | (SEQ ID NO: 1466) |

FIG. 2

| Sequence | ID |
|---|---|
| Pro Gly Xaa' Thr Cys Gly Glu Ile Xaa' Cys Ala Tyr Ala Ala Xaa' Xaa' Cys Thr Gly Cys | (SEQ ID NO: 1467) |
| Pro Gly Xaa' Thr Cys Gly Glu Ile Xaa' Cys Ala Tyr Ala Ala Xaa' Cys Xaa' Thr Gly Cys | (SEQ ID NO: 1468) |
| Pro Gly Xaa' Thr Cys Gly Glu Ile Xaa' Cys Ala Tyr Ala Ala Xaa' Cys Thr Xaa' Gly Cys | (SEQ ID NO: 1469) |
| Pro Gly Xaa' Thr Cys Gly Glu Ile Xaa' Cys Ala Tyr Ala Ala Xaa' Cys Thr Gly Xaa' Cys | (SEQ ID NO: 1470) |
| Pro Gly Xaa' Thr Cys Gly Glu Ile Xaa' Cys Ala Tyr Ala Ala Xaa' Cys Thr Gly Cys Xaa' | (SEQ ID NO: 1471) |
| Pro Gly Xaa' Thr Cys Gly Glu Ile Xaa' Cys Ala Tyr Ala Ala Cys Xaa' Xaa' Thr Gly Cys | (SEQ ID NO: 1472) |
| Pro Gly Xaa' Thr Cys Gly Glu Ile Xaa' Cys Ala Tyr Ala Ala Cys Xaa' Thr Xaa' Gly Cys | (SEQ ID NO: 1473) |
| Pro Gly Xaa' Thr Cys Gly Glu Ile Xaa' Cys Ala Tyr Ala Ala Cys Xaa' Thr Gly Xaa' Cys | (SEQ ID NO: 1474) |
| Pro Gly Xaa' Thr Cys Gly Glu Ile Xaa' Cys Ala Tyr Ala Ala Cys Xaa' Thr Gly Cys Xaa' | (SEQ ID NO: 1475) |
| Pro Gly Xaa' Thr Cys Gly Glu Ile Xaa' Cys Ala Tyr Ala Ala Cys Thr Xaa' Xaa' Gly Cys | (SEQ ID NO: 1476) |
| Pro Gly Xaa' Thr Cys Gly Glu Ile Xaa' Cys Ala Tyr Ala Ala Cys Thr Xaa' Gly Xaa' Cys | (SEQ ID NO: 1477) |
| Pro Gly Xaa' Thr Cys Gly Glu Ile Xaa' Cys Ala Tyr Ala Ala Cys Thr Xaa' Gly Cys Xaa' | (SEQ ID NO: 1478) |
| Pro Gly Xaa' Thr Cys Gly Glu Ile Xaa' Cys Ala Tyr Ala Ala Cys Thr Gly Xaa' Xaa' Cys | (SEQ ID NO: 1479) |
| Pro Gly Xaa' Thr Cys Gly Glu Ile Xaa' Cys Ala Tyr Ala Ala Cys Thr Gly Xaa' Cys Xaa' | (SEQ ID NO: 1480) |
| Pro Gly Xaa' Thr Cys Gly Glu Ile Xaa' Cys Ala Tyr Ala Ala Cys Thr Gly Cys Xaa' Xaa' | (SEQ ID NO: 1481) |
| Pro Gly Xaa' Thr Cys Gly Glu Ile Xaa' Cys Ala Tyr Ala Xaa' Xaa' Ala Cys Thr Gly Cys | (SEQ ID NO: 1482) |
| Pro Gly Xaa' Thr Cys Gly Glu Ile Xaa' Cys Ala Tyr Ala Xaa' Ala Xaa' Cys Thr Gly Cys | (SEQ ID NO: 1483) |
| Pro Gly Xaa' Thr Cys Gly Glu Ile Xaa' Cys Ala Tyr Ala Xaa' Ala Cys Xaa' Thr Gly Cys | (SEQ ID NO: 1484) |
| Pro Gly Xaa' Thr Cys Gly Glu Ile Xaa' Cys Ala Tyr Ala Xaa' Ala Cys Thr Xaa' Gly Cys | (SEQ ID NO: 1485) |
| Pro Gly Xaa' Thr Cys Gly Glu Ile Xaa' Cys Ala Tyr Ala Xaa' Ala Cys Thr Gly Xaa' Cys | (SEQ ID NO: 1486) |
| Pro Gly Xaa' Thr Cys Gly Glu Ile Xaa' Cys Ala Tyr Ala Xaa' Ala Cys Thr Gly Cys Xaa' | (SEQ ID NO: 1487) |
| Pro Gly Xaa' Thr Cys Gly Glu Ile Xaa' Cys Ala Tyr Xaa' Ala Ala Ala Cys Thr Gly Cys | (SEQ ID NO: 1488) |
| Pro Gly Xaa' Thr Cys Gly Glu Ile Xaa' Cys Ala Tyr Xaa' Ala Ala Cys Xaa' Thr Gly Cys | (SEQ ID NO: 1489) |
| Pro Gly Xaa' Thr Cys Gly Glu Ile Xaa' Cys Ala Tyr Xaa' Ala Ala Cys Thr Xaa' Gly Cys | (SEQ ID NO: 1490) |
| Pro Gly Xaa' Thr Cys Gly Glu Ile Xaa' Cys Ala Tyr Xaa' Ala Ala Cys Thr Gly Xaa' Cys | (SEQ ID NO: 1491) |
| Pro Gly Xaa' Thr Cys Gly Glu Ile Xaa' Cys Ala Tyr Xaa' Ala Ala Cys Thr Gly Cys Xaa' | (SEQ ID NO: 1492) |
| Pro Gly Xaa' Thr Cys Gly Glu Ile Xaa' Cys Xaa' Ala Tyr Ala Ala Ala Cys Thr Gly Cys | (SEQ ID NO: 1493) |
| Pro Gly Xaa' Thr Cys Gly Glu Ile Xaa' Cys Xaa' Ala Tyr Ala Ala Cys Xaa' Thr Gly Cys | (SEQ ID NO: 1494) |
| Pro Gly Xaa' Thr Cys Gly Glu Ile Xaa' Cys Xaa' Ala Tyr Ala Ala Cys Thr Xaa' Gly Cys | (SEQ ID NO: 1495) |
| Pro Gly Xaa' Thr Cys Gly Glu Ile Xaa' Cys Xaa' Ala Tyr Ala Ala Cys Thr Gly Xaa' Cys | (SEQ ID NO: 1496) |
| Pro Gly Xaa' Thr Cys Gly Glu Ile Xaa' Cys Xaa' Ala Tyr Ala Ala Cys Thr Gly Cys Xaa' | (SEQ ID NO: 1497) |
| Pro Gly Xaa' Thr Cys Gly Glu Ile Cys Ala Xaa' Xaa' Tyr Ala Ala Ala Cys Thr Gly Cys | (SEQ ID NO: 1498) |
| Pro Gly Xaa' Thr Cys Gly Glu Ile Cys Ala Xaa' Tyr Xaa' Ala Ala Ala Cys Thr Gly Cys | (SEQ ID NO: 1499) |
| Pro Gly Xaa' Thr Cys Gly Glu Ile Cys Ala Xaa' Tyr Ala Xaa' Ala Ala Cys Thr Gly Cys | (SEQ ID NO: 1500) |

FIG. 2

| | | | | | | | | | | | | |
|---|---|---|---|---|---|---|---|---|---|---|---|---|
| Pro | Gly | Xaa' | Thr | Cys | Gly | Glu | Ile | Cys | Xaa' | Ala | Xaa' | Tyr | Ala | Ala | Xaa' | Cys | Thr | Gly | Cys | (SEQ ID NO: 1501) |
| Pro | Gly | Xaa' | Thr | Cys | Gly | Glu | Ile | Cys | Xaa' | Ala | Xaa' | Tyr | Ala | Ala | Cys | Xaa' | Thr | Gly | Cys | (SEQ ID NO: 1502) |
| Pro | Gly | Xaa' | Thr | Cys | Gly | Glu | Ile | Cys | Xaa' | Ala | Xaa' | Tyr | Ala | Ala | Cys | Thr | Xaa' | Gly | Cys | (SEQ ID NO: 1503) |
| Pro | Gly | Xaa' | Thr | Cys | Gly | Glu | Ile | Cys | Xaa' | Ala | Xaa' | Tyr | Ala | Ala | Cys | Thr | Gly | Xaa' | Cys | (SEQ ID NO: 1504) |
| Pro | Gly | Xaa' | Thr | Cys | Gly | Glu | Ile | Cys | Xaa' | Ala | Xaa' | Tyr | Ala | Ala | Cys | Thr | Gly | Cys | Xaa' | (SEQ ID NO: 1505) |
| Pro | Gly | Xaa' | Thr | Cys | Gly | Glu | Ile | Cys | Xaa' | Ala | Tyr | Xaa' | Ala | Ala | Cys | Thr | Gly | Cys | (SEQ ID NO: 1506) |
| Pro | Gly | Xaa' | Thr | Cys | Gly | Glu | Ile | Cys | Xaa' | Ala | Tyr | Xaa' | Ala | Ala | Xaa' | Cys | Thr | Gly | Cys | (SEQ ID NO: 1507) |
| Pro | Gly | Xaa' | Thr | Cys | Gly | Glu | Ile | Cys | Xaa' | Ala | Tyr | Xaa' | Ala | Ala | Cys | Xaa' | Thr | Gly | Cys | (SEQ ID NO: 1508) |
| Pro | Gly | Xaa' | Thr | Cys | Gly | Glu | Ile | Cys | Xaa' | Ala | Tyr | Xaa' | Ala | Ala | Cys | Thr | Xaa' | Gly | Cys | (SEQ ID NO: 1509) |
| Pro | Gly | Xaa' | Thr | Cys | Gly | Glu | Ile | Cys | Xaa' | Ala | Tyr | Xaa' | Ala | Ala | Cys | Thr | Gly | Xaa' | Cys | (SEQ ID NO: 1510) |
| Pro | Gly | Xaa' | Thr | Cys | Gly | Glu | Ile | Cys | Xaa' | Ala | Tyr | Xaa' | Ala | Ala | Cys | Thr | Gly | Cys | Xaa' | (SEQ ID NO: 1511) |
| Pro | Gly | Xaa' | Thr | Cys | Gly | Glu | Ile | Cys | Xaa' | Ala | Tyr | Ala | Xaa' | Ala | Cys | Thr | Gly | Cys | (SEQ ID NO: 1512) |
| Pro | Gly | Xaa' | Thr | Cys | Gly | Glu | Ile | Cys | Xaa' | Ala | Tyr | Ala | Xaa' | Ala | Xaa' | Cys | Thr | Gly | Cys | (SEQ ID NO: 1513) |
| Pro | Gly | Xaa' | Thr | Cys | Gly | Glu | Ile | Cys | Xaa' | Ala | Tyr | Ala | Xaa' | Ala | Cys | Xaa' | Thr | Gly | Cys | (SEQ ID NO: 1514) |
| Pro | Gly | Xaa' | Thr | Cys | Gly | Glu | Ile | Cys | Xaa' | Ala | Tyr | Ala | Xaa' | Ala | Cys | Thr | Xaa' | Gly | Cys | (SEQ ID NO: 1515) |
| Pro | Gly | Xaa' | Thr | Cys | Gly | Glu | Ile | Cys | Xaa' | Ala | Tyr | Ala | Xaa' | Ala | Cys | Thr | Gly | Xaa' | Cys | (SEQ ID NO: 1516) |
| Pro | Gly | Xaa' | Thr | Cys | Gly | Glu | Ile | Cys | Xaa' | Ala | Tyr | Ala | Xaa' | Ala | Cys | Thr | Gly | Cys | Xaa' | (SEQ ID NO: 1517) |
| Pro | Gly | Xaa' | Thr | Cys | Gly | Glu | Ile | Cys | Xaa' | Ala | Tyr | Ala | Ala | Xaa' | Cys | Thr | Gly | Cys | (SEQ ID NO: 1518) |
| Pro | Gly | Xaa' | Thr | Cys | Gly | Glu | Ile | Cys | Xaa' | Ala | Tyr | Ala | Ala | Xaa' | Xaa' | Cys | Thr | Gly | Cys | (SEQ ID NO: 1519) |
| Pro | Gly | Xaa' | Thr | Cys | Gly | Glu | Ile | Cys | Xaa' | Ala | Tyr | Ala | Ala | Xaa' | Cys | Xaa' | Thr | Gly | Cys | (SEQ ID NO: 1520) |
| Pro | Gly | Xaa' | Thr | Cys | Gly | Glu | Ile | Cys | Xaa' | Ala | Tyr | Ala | Ala | Xaa' | Cys | Thr | Xaa' | Gly | Cys | (SEQ ID NO: 1521) |
| Pro | Gly | Xaa' | Thr | Cys | Gly | Glu | Ile | Cys | Xaa' | Ala | Tyr | Ala | Ala | Xaa' | Cys | Thr | Gly | Xaa' | Cys | (SEQ ID NO: 1522) |
| Pro | Gly | Xaa' | Thr | Cys | Gly | Glu | Ile | Cys | Xaa' | Ala | Tyr | Ala | Ala | Xaa' | Cys | Thr | Gly | Cys | Xaa' | (SEQ ID NO: 1523) |
| Pro | Gly | Xaa' | Thr | Cys | Gly | Glu | Ile | Cys | Xaa' | Ala | Tyr | Ala | Ala | Cys | Xaa' | Thr | Gly | Cys | (SEQ ID NO: 1524) |
| Pro | Gly | Xaa' | Thr | Cys | Gly | Glu | Ile | Cys | Xaa' | Ala | Tyr | Ala | Ala | Cys | Xaa' | Xaa' | Thr | Gly | Cys | (SEQ ID NO: 1525) |
| Pro | Gly | Xaa' | Thr | Cys | Gly | Glu | Ile | Cys | Xaa' | Ala | Tyr | Ala | Ala | Cys | Xaa' | Thr | Xaa' | Gly | Cys | (SEQ ID NO: 1526) |
| Pro | Gly | Xaa' | Thr | Cys | Gly | Glu | Ile | Cys | Xaa' | Ala | Tyr | Ala | Ala | Cys | Xaa' | Thr | Gly | Xaa' | Cys | (SEQ ID NO: 1527) |
| Pro | Gly | Xaa' | Thr | Cys | Gly | Glu | Ile | Cys | Xaa' | Ala | Tyr | Ala | Ala | Cys | Xaa' | Thr | Gly | Cys | Xaa' | (SEQ ID NO: 1528) |
| Pro | Gly | Xaa' | Thr | Cys | Gly | Glu | Ile | Cys | Xaa' | Ala | Tyr | Ala | Ala | Cys | Thr | Xaa' | Gly | Cys | (SEQ ID NO: 1529) |
| Pro | Gly | Xaa' | Thr | Cys | Gly | Glu | Ile | Cys | Xaa' | Ala | Tyr | Ala | Ala | Cys | Thr | Xaa' | Xaa' | Gly | Cys | (SEQ ID NO: 1530) |
| Pro | Gly | Xaa' | Thr | Cys | Gly | Glu | Ile | Cys | Xaa' | Ala | Tyr | Ala | Ala | Cys | Thr | Xaa' | Gly | Xaa' | Cys | (SEQ ID NO: 1531) |
| Pro | Gly | Xaa' | Thr | Cys | Gly | Glu | Ile | Cys | Xaa' | Ala | Tyr | Ala | Ala | Cys | Thr | Xaa' | Gly | Cys | Xaa' | (SEQ ID NO: 1532) |
| Pro | Gly | Xaa' | Thr | Cys | Gly | Glu | Ile | Cys | Xaa' | Ala | Tyr | Ala | Ala | Cys | Thr | Gly | Xaa' | Cys | (SEQ ID NO: 1533) |
| Pro | Gly | Xaa' | Thr | Cys | Gly | Glu | Ile | Cys | Xaa' | Ala | Tyr | Ala | Ala | Cys | Thr | Gly | Xaa' | Xaa' | Cys | (SEQ ID NO: 1534) |

FIG. 2

| | SEQ ID NO |
|---|---|
| Pro Gly Xaa' Thr Cys Gly Glu Ile Cys Xaa' Ala Tyr Ala Ala Cys Thr Xaa' Gly Cys Xaa' | (SEQ ID NO: 1535) |
| Pro Gly Xaa' Thr Cys Gly Glu Ile Cys Xaa' Ala Tyr Ala Ala Cys Thr Gly Xaa' Cys | (SEQ ID NO: 1536) |
| Pro Gly Xaa' Thr Cys Gly Glu Ile Cys Xaa' Ala Tyr Ala Ala Cys Thr Gly Cys Xaa' Cys | (SEQ ID NO: 1537) |
| Pro Gly Xaa' Thr Cys Gly Glu Ile Cys Xaa' Ala Tyr Ala Ala Cys Thr Gly Xaa' Cys Xaa' | (SEQ ID NO: 1538) |
| Pro Gly Xaa' Thr Cys Gly Glu Ile Cys Xaa' Ala Tyr Ala Ala Cys Thr Gly Cys Xaa' | (SEQ ID NO: 1539) |
| Pro Gly Xaa' Thr Cys Gly Glu Ile Cys Xaa' Ala Tyr Ala Ala Cys Thr Gly Cys Xaa' Xaa' | (SEQ ID NO: 1540) |
| Pro Gly Xaa' Thr Cys Gly Glu Ile Cys Ala Xaa' Tyr Ala Ala Cys Thr Gly Cys | (SEQ ID NO: 1541) |
| Pro Gly Xaa' Thr Cys Gly Glu Ile Cys Ala Xaa' Tyr Ala Ala Cys Thr Gly Cys | (SEQ ID NO: 1542) |
| Pro Gly Xaa' Thr Cys Gly Glu Ile Cys Ala Xaa' Xaa' Tyr Ala Ala Cys Thr Gly Cys | (SEQ ID NO: 1543) |
| Pro Gly Xaa' Thr Cys Gly Glu Ile Cys Ala Xaa' Xaa' Tyr Ala Ala Cys Thr Gly Cys | (SEQ ID NO: 1544) |
| Pro Gly Xaa' Thr Cys Gly Glu Ile Cys Ala Xaa' Tyr Xaa' Ala Ala Cys Thr Gly Cys | (SEQ ID NO: 1545) |
| Pro Gly Xaa' Thr Cys Gly Glu Ile Cys Ala Xaa' Tyr Xaa' Ala Ala Cys Thr Gly Cys | (SEQ ID NO: 1546) |
| Pro Gly Xaa' Thr Cys Gly Glu Ile Cys Ala Xaa' Tyr Ala Xaa' Ala Cys Thr Gly Cys | (SEQ ID NO: 1547) |
| Pro Gly Xaa' Thr Cys Gly Glu Ile Cys Ala Xaa' Tyr Ala Xaa' Ala Cys Thr Gly Cys | (SEQ ID NO: 1548) |
| Pro Gly Xaa' Thr Cys Gly Glu Ile Cys Ala Xaa' Tyr Ala Ala Xaa' Cys Thr Gly Xaa' Cys | (SEQ ID NO: 1549) |
| Pro Gly Xaa' Thr Cys Gly Glu Ile Cys Ala Xaa' Tyr Ala Ala Cys Thr Gly Cys Xaa' | (SEQ ID NO: 1550) |
| Pro Gly Xaa' Thr Cys Gly Glu Ile Cys Ala Xaa' Tyr Ala Ala Cys Thr Gly Cys | (SEQ ID NO: 1551) |
| Pro Gly Xaa' Thr Cys Gly Glu Ile Cys Ala Xaa' Tyr Xaa' Ala Ala Cys Thr Gly Cys | (SEQ ID NO: 1552) |
| Pro Gly Xaa' Thr Cys Gly Glu Ile Cys Ala Xaa' Tyr Xaa' Ala Ala Cys Thr Gly Cys | (SEQ ID NO: 1553) |
| Pro Gly Xaa' Thr Cys Gly Glu Ile Cys Ala Xaa' Tyr Xaa' Ala Ala Cys Thr Gly Cys | (SEQ ID NO: 1554) |
| Pro Gly Xaa' Thr Cys Gly Glu Ile Cys Ala Xaa' Tyr Xaa' Ala Ala Cys Thr Xaa' Gly Cys | (SEQ ID NO: 1555) |
| Pro Gly Xaa' Thr Cys Gly Glu Ile Cys Ala Xaa' Tyr Xaa' Ala Ala Cys Thr Gly Xaa' Cys | (SEQ ID NO: 1556) |
| Pro Gly Xaa' Thr Cys Gly Glu Ile Cys Ala Xaa' Tyr Xaa' Ala Ala Cys Thr Gly Xaa' Cys | (SEQ ID NO: 1557) |
| Pro Gly Xaa' Thr Cys Gly Glu Ile Cys Ala Xaa' Tyr Xaa' Ala Ala Cys Thr Gly Cys Xaa' | (SEQ ID NO: 1558) |
| Pro Gly Xaa' Thr Cys Gly Glu Ile Cys Ala Xaa' Tyr Xaa' Ala Ala Cys Thr Gly Cys | (SEQ ID NO: 1559) |
| Pro Gly Xaa' Thr Cys Gly Glu Ile Cys Ala Xaa' Tyr Ala Xaa' Ala Cys Thr Gly Cys | (SEQ ID NO: 1560) |
| Pro Gly Xaa' Thr Cys Gly Glu Ile Cys Ala Xaa' Tyr Ala Xaa' Ala Cys Thr Gly Cys | (SEQ ID NO: 1561) |
| Pro Gly Xaa' Thr Cys Gly Glu Ile Cys Ala Xaa' Tyr Ala Xaa' Ala Cys Thr Gly Cys | (SEQ ID NO: 1562) |
| Pro Gly Xaa' Thr Cys Gly Glu Ile Cys Ala Xaa' Tyr Ala Xaa' Ala Cys Thr Gly Cys | (SEQ ID NO: 1563) |
| Pro Gly Xaa' Thr Cys Gly Glu Ile Cys Ala Xaa' Tyr Ala Xaa' Ala Cys Thr Gly Xaa' Cys | (SEQ ID NO: 1564) |
| Pro Gly Xaa' Thr Cys Gly Glu Ile Cys Ala Xaa' Tyr Ala Ala Xaa' Cys Thr Gly Cys | (SEQ ID NO: 1565) |
| Pro Gly Xaa' Thr Cys Gly Glu Ile Cys Ala Xaa' Tyr Ala Ala Xaa' Cys Thr Gly Cys Xaa' | (SEQ ID NO: 1566) |
| Pro Gly Xaa' Thr Cys Gly Glu Ile Cys Ala Ala Tyr Ala Ala Xaa' Cys Xaa' Thr Gly Cys | (SEQ ID NO: 1567) |
| Pro Gly Xaa' Thr Cys Gly Glu Ile Cys Ala Xaa' Tyr Ala Ala Xaa' Cys Xaa' Thr Gly Cys | (SEQ ID NO: 1568) |

FIG. 2

| | | | | | | | | | | | | |
|---|---|---|---|---|---|---|---|---|---|---|---|---|
| Pro | Gly | Xaa' | Thr | Cys | Gly | Glu | Ile | Cys | Ala | Xaa' | Tyr | Ala | Ala | Xaa' | Cys | Thr | Xaa' | Gly | Cys | (SEQ ID NO: 1569) |
| Pro | Gly | Xaa' | Thr | Cys | Gly | Glu | Ile | Cys | Ala | Xaa' | Tyr | Ala | Ala | Xaa' | Cys | Thr | Gly | Xaa' | Cys | (SEQ ID NO: 1570) |
| Pro | Gly | Xaa' | Thr | Cys | Gly | Glu | Ile | Cys | Ala | Xaa' | Tyr | Ala | Ala | Xaa' | Cys | Thr | Gly | Cys | Xaa' | (SEQ ID NO: 1571) |
| Pro | Gly | Xaa' | Thr | Cys | Gly | Glu | Ile | Cys | Ala | Xaa' | Tyr | Ala | Ala | Cys | Xaa' | Thr | Gly | Cys | (SEQ ID NO: 1572) |
| Pro | Gly | Xaa' | Thr | Cys | Gly | Glu | Ile | Cys | Ala | Xaa' | Tyr | Ala | Ala | Cys | Xaa' | Thr | Xaa' | Gly | Cys | (SEQ ID NO: 1573) |
| Pro | Gly | Xaa' | Thr | Cys | Gly | Glu | Ile | Cys | Ala | Xaa' | Tyr | Ala | Ala | Cys | Xaa' | Thr | Gly | Xaa' | Cys | (SEQ ID NO: 1574) |
| Pro | Gly | Xaa' | Thr | Cys | Gly | Glu | Ile | Cys | Ala | Xaa' | Tyr | Ala | Ala | Cys | Xaa' | Thr | Gly | Cys | Xaa' | (SEQ ID NO: 1575) |
| Pro | Gly | Xaa' | Thr | Cys | Gly | Glu | Ile | Cys | Ala | Xaa' | Tyr | Ala | Ala | Cys | Thr | Xaa' | Gly | Cys | (SEQ ID NO: 1576) |
| Pro | Gly | Xaa' | Thr | Cys | Gly | Glu | Ile | Cys | Ala | Xaa' | Tyr | Ala | Ala | Cys | Thr | Xaa' | Gly | Cys | Xaa' | (SEQ ID NO: 1577) |
| Pro | Gly | Xaa' | Thr | Cys | Gly | Glu | Ile | Cys | Ala | Xaa' | Tyr | Ala | Ala | Cys | Thr | Xaa' | Xaa' | Gly | Cys | (SEQ ID NO: 1578) |
| Pro | Gly | Xaa' | Thr | Cys | Gly | Glu | Ile | Cys | Ala | Xaa' | Tyr | Ala | Ala | Cys | Thr | Xaa' | Gly | Xaa' | Cys | (SEQ ID NO: 1579) |
| Pro | Gly | Xaa' | Thr | Cys | Gly | Glu | Ile | Cys | Ala | Xaa' | Tyr | Ala | Ala | Cys | Thr | Gly | Xaa' | Cys | Xaa' | (SEQ ID NO: 1580) |
| Pro | Gly | Xaa' | Thr | Cys | Gly | Glu | Ile | Cys | Ala | Xaa' | Tyr | Ala | Ala | Cys | Thr | Gly | Xaa' | Xaa' | Cys | (SEQ ID NO: 1581) |
| Pro | Gly | Xaa' | Thr | Cys | Gly | Glu | Ile | Cys | Ala | Xaa' | Tyr | Ala | Ala | Cys | Thr | Gly | Cys | Xaa' | Xaa' | (SEQ ID NO: 1582) |
| Pro | Gly | Xaa' | Thr | Cys | Gly | Glu | Ile | Cys | Ala | Xaa' | Tyr | Ala | Ala | Cys | Thr | Gly | Xaa' | Cys | Xaa' | (SEQ ID NO: 1583) |
| Pro | Gly | Xaa' | Thr | Cys | Gly | Glu | Ile | Cys | Ala | Xaa' | Tyr | Ala | Ala | Cys | Thr | Gly | Cys | Xaa' | (SEQ ID NO: 1584) |
| Pro | Gly | Xaa' | Thr | Cys | Gly | Glu | Ile | Cys | Ala | Xaa' | Tyr | Xaa' | Ala | Ala | Cys | Thr | Gly | Cys | Xaa' | (SEQ ID NO: 1585) |
| Pro | Gly | Xaa' | Thr | Cys | Gly | Glu | Ile | Cys | Ala | Xaa' | Tyr | Xaa' | Ala | Ala | Cys | Thr | Gly | Cys | (SEQ ID NO: 1586) |
| Pro | Gly | Xaa' | Thr | Cys | Gly | Glu | Ile | Cys | Ala | Xaa' | Tyr | Xaa' | Ala | Ala | Cys | Ala | Cys | Thr | Gly | Cys | (SEQ ID NO: 1587) |
| Pro | Gly | Xaa' | Thr | Cys | Gly | Glu | Ile | Cys | Ala | Xaa' | Tyr | Xaa' | Xaa' | Ala | Ala | Cys | Ala | Cys | Thr | Gly | Cys | (SEQ ID NO: 1588) |
| Pro | Gly | Xaa' | Thr | Cys | Gly | Glu | Ile | Cys | Ala | Xaa' | Tyr | Xaa' | Ala | Ala | Xaa' | Cys | Ala | Cys | Thr | Gly | Cys | (SEQ ID NO: 1589) |
| Pro | Gly | Xaa' | Thr | Cys | Gly | Glu | Ile | Cys | Ala | Xaa' | Tyr | Xaa' | Ala | Ala | Xaa' | Cys | Ala | Xaa' | Thr | Gly | Cys | (SEQ ID NO: 1590) |
| Pro | Gly | Xaa' | Thr | Cys | Gly | Glu | Ile | Cys | Ala | Xaa' | Tyr | Xaa' | Ala | Ala | Ala | Cys | Xaa' | Thr | Gly | Cys | (SEQ ID NO: 1591) |
| Pro | Gly | Xaa' | Thr | Cys | Gly | Glu | Ile | Cys | Ala | Xaa' | Tyr | Xaa' | Ala | Ala | Ala | Cys | Xaa' | Thr | Gly | Cys | (SEQ ID NO: 1592) |
| Pro | Gly | Xaa' | Thr | Cys | Gly | Glu | Ile | Cys | Ala | Xaa' | Tyr | Xaa' | Ala | Ala | Ala | Cys | Thr | Xaa' | Gly | Cys | (SEQ ID NO: 1593) |
| Pro | Gly | Xaa' | Thr | Cys | Gly | Glu | Ile | Cys | Ala | Xaa' | Tyr | Xaa' | Ala | Ala | Ala | Cys | Thr | Gly | Xaa' | Cys | (SEQ ID NO: 1594) |
| Pro | Gly | Xaa' | Thr | Cys | Gly | Glu | Ile | Cys | Ala | Xaa' | Tyr | Xaa' | Ala | Ala | Ala | Cys | Thr | Gly | Cys | Xaa' | (SEQ ID NO: 1595) |
| Pro | Gly | Xaa' | Thr | Cys | Gly | Glu | Ile | Cys | Ala | Xaa' | Tyr | Xaa' | Ala | Ala | Ala | Cys | Xaa' | Thr | Gly | Cys | (SEQ ID NO: 1596) |
| Pro | Gly | Xaa' | Thr | Cys | Gly | Glu | Ile | Cys | Ala | Xaa' | Tyr | Xaa' | Ala | Ala | Ala | Cys | Xaa' | Thr | Gly | Cys | (SEQ ID NO: 1597) |
| Pro | Gly | Xaa' | Thr | Cys | Gly | Glu | Ile | Cys | Ala | Xaa' | Tyr | Xaa' | Ala | Ala | Ala | Cys | Thr | Xaa' | Gly | Cys | (SEQ ID NO: 1598) |
| Pro | Gly | Xaa' | Thr | Cys | Gly | Glu | Ile | Cys | Ala | Xaa' | Tyr | Xaa' | Ala | Ala | Ala | Cys | Thr | Gly | Xaa' | Cys | (SEQ ID NO: 1599) |
| Pro | Gly | Xaa' | Thr | Cys | Gly | Glu | Ile | Cys | Ala | Xaa' | Tyr | Xaa' | Ala | Ala | Ala | Cys | Thr | Gly | Cys | (SEQ ID NO: 1600) |
| Pro | Gly | Xaa' | Thr | Cys | Gly | Glu | Ile | Cys | Ala | Xaa' | Tyr | Xaa' | Ala | Ala | Ala | Cys | Thr | Gly | Cys | Xaa' | (SEQ ID NO: 1601) |
| Pro | Gly | Xaa' | Thr | Cys | Gly | Glu | Ile | Cys | Ala | Tyr | Xaa' | Ala | Ala | Xaa' | Cys | Thr | Gly | Cys | (SEQ ID NO: 1602) |

FIG. 2

| | | | | | | | | | | | | |
|---|---|---|---|---|---|---|---|---|---|---|---|---|
| Pro | Gly | Xaa' | Thr | Cys | Gly | Glu | Ile | Cys | Ala | Tyr | Xaa' | Ala | Ala | Xaa' | Xaa' | Cys | Thr | Gly | Cys | (SEQ ID NO: 1603) |
| Pro | Gly | Xaa' | Thr | Cys | Gly | Glu | Ile | Cys | Ala | Tyr | Xaa' | Ala | Ala | Xaa' | Cys | Xaa' | Thr | Gly | Cys | (SEQ ID NO: 1604) |
| Pro | Gly | Xaa' | Thr | Cys | Gly | Glu | Ile | Cys | Ala | Tyr | Xaa' | Ala | Ala | Xaa' | Cys | Thr | Xaa' | Gly | Cys | (SEQ ID NO: 1605) |
| Pro | Gly | Xaa' | Thr | Cys | Gly | Glu | Ile | Cys | Ala | Tyr | Xaa' | Ala | Ala | Xaa' | Cys | Thr | Gly | Xaa' | Cys | (SEQ ID NO: 1606) |
| Pro | Gly | Xaa' | Thr | Cys | Gly | Glu | Ile | Cys | Ala | Tyr | Xaa' | Ala | Ala | Xaa' | Cys | Thr | Gly | Cys | Xaa' | (SEQ ID NO: 1607) |
| Pro | Gly | Xaa' | Thr | Cys | Gly | Glu | Ile | Cys | Ala | Tyr | Xaa' | Ala | Ala | Cys | Xaa' | Xaa' | Thr | Gly | Cys | (SEQ ID NO: 1608) |
| Pro | Gly | Xaa' | Thr | Cys | Gly | Glu | Ile | Cys | Ala | Tyr | Xaa' | Ala | Ala | Cys | Xaa' | Thr | Xaa' | Gly | Cys | (SEQ ID NO: 1609) |
| Pro | Gly | Xaa' | Thr | Cys | Gly | Glu | Ile | Cys | Ala | Tyr | Xaa' | Ala | Ala | Cys | Xaa' | Thr | Gly | Xaa' | Cys | (SEQ ID NO: 1610) |
| Pro | Gly | Xaa' | Thr | Cys | Gly | Glu | Ile | Cys | Ala | Tyr | Xaa' | Ala | Ala | Cys | Xaa' | Thr | Gly | Cys | Xaa' | (SEQ ID NO: 1611) |
| Pro | Gly | Xaa' | Thr | Cys | Gly | Glu | Ile | Cys | Ala | Tyr | Xaa' | Ala | Ala | Cys | Thr | Xaa' | Xaa' | Gly | Cys | (SEQ ID NO: 1612) |
| Pro | Gly | Xaa' | Thr | Cys | Gly | Glu | Ile | Cys | Ala | Tyr | Xaa' | Ala | Ala | Cys | Thr | Xaa' | Gly | Xaa' | Cys | (SEQ ID NO: 1613) |
| Pro | Gly | Xaa' | Thr | Cys | Gly | Glu | Ile | Cys | Ala | Tyr | Xaa' | Ala | Ala | Cys | Thr | Xaa' | Gly | Cys | Xaa' | (SEQ ID NO: 1614) |
| Pro | Gly | Xaa' | Thr | Cys | Gly | Glu | Ile | Cys | Ala | Tyr | Xaa' | Ala | Ala | Cys | Thr | Gly | Xaa' | Xaa' | Cys | (SEQ ID NO: 1615) |
| Pro | Gly | Xaa' | Thr | Cys | Gly | Glu | Ile | Cys | Ala | Tyr | Xaa' | Ala | Ala | Cys | Thr | Gly | Xaa' | Cys | Xaa' | (SEQ ID NO: 1616) |
| Pro | Gly | Xaa' | Thr | Cys | Gly | Glu | Ile | Cys | Ala | Tyr | Xaa' | Ala | Ala | Cys | Thr | Gly | Cys | Xaa' | Cys | (SEQ ID NO: 1617) |
| Pro | Gly | Xaa' | Thr | Cys | Gly | Glu | Ile | Cys | Ala | Tyr | Ala | Xaa' | Xaa' | Xaa' | Cys | Thr | Gly | Xaa' | Cys | (SEQ ID NO: 1618) |
| Pro | Gly | Xaa' | Thr | Cys | Gly | Glu | Ile | Cys | Ala | Tyr | Ala | Xaa' | Xaa' | Xaa' | Ala | Cys | Thr | Gly | Cys | (SEQ ID NO: 1619) |
| Pro | Gly | Xaa' | Thr | Cys | Gly | Glu | Ile | Cys | Ala | Tyr | Ala | Xaa' | Xaa' | Xaa' | Cys | Thr | Gly | Cys | Xaa' | (SEQ ID NO: 1620) |
| Pro | Gly | Xaa' | Thr | Cys | Gly | Glu | Ile | Cys | Ala | Tyr | Ala | Xaa' | Xaa' | Ala | Cys | Thr | Gly | Cys | | (SEQ ID NO: 1621) |
| Pro | Gly | Xaa' | Thr | Cys | Gly | Glu | Ile | Cys | Ala | Tyr | Ala | Xaa' | Xaa' | Ala | Cys | Xaa' | Thr | Gly | Cys | (SEQ ID NO: 1622) |
| Pro | Gly | Xaa' | Thr | Cys | Gly | Glu | Ile | Cys | Ala | Tyr | Ala | Xaa' | Xaa' | Ala | Cys | Thr | Xaa' | Gly | Cys | (SEQ ID NO: 1623) |
| Pro | Gly | Xaa' | Thr | Cys | Gly | Glu | Ile | Cys | Ala | Tyr | Ala | Xaa' | Xaa' | Ala | Cys | Thr | Gly | Xaa' | Cys | (SEQ ID NO: 1624) |
| Pro | Gly | Xaa' | Thr | Cys | Gly | Glu | Ile | Cys | Ala | Tyr | Ala | Xaa' | Xaa' | Ala | Cys | Thr | Gly | Cys | Xaa' | (SEQ ID NO: 1625) |
| Pro | Gly | Xaa' | Thr | Cys | Gly | Glu | Ile | Cys | Ala | Tyr | Ala | Xaa' | Ala | Xaa' | Cys | Thr | Gly | Cys | | (SEQ ID NO: 1626) |
| Pro | Gly | Xaa' | Thr | Cys | Gly | Glu | Ile | Cys | Ala | Tyr | Ala | Xaa' | Ala | Xaa' | Cys | Xaa' | Thr | Gly | Cys | (SEQ ID NO: 1627) |
| Pro | Gly | Xaa' | Thr | Cys | Gly | Glu | Ile | Cys | Ala | Tyr | Ala | Xaa' | Ala | Xaa' | Cys | Thr | Xaa' | Gly | Cys | (SEQ ID NO: 1628) |
| Pro | Gly | Xaa' | Thr | Cys | Gly | Glu | Ile | Cys | Ala | Tyr | Ala | Xaa' | Ala | Xaa' | Cys | Thr | Gly | Xaa' | Cys | (SEQ ID NO: 1629) |
| Pro | Gly | Xaa' | Thr | Cys | Gly | Glu | Ile | Cys | Ala | Tyr | Ala | Xaa' | Ala | Xaa' | Cys | Thr | Gly | Cys | Xaa' | (SEQ ID NO: 1630) |
| Pro | Gly | Xaa' | Thr | Cys | Gly | Glu | Ile | Cys | Ala | Tyr | Ala | Xaa' | Ala | Cys | Xaa' | Xaa' | Thr | Gly | Cys | (SEQ ID NO: 1631) |
| Pro | Gly | Xaa' | Thr | Cys | Gly | Glu | Ile | Cys | Ala | Tyr | Ala | Xaa' | Ala | Cys | Xaa' | Thr | Xaa' | Gly | Cys | (SEQ ID NO: 1632) |
| Pro | Gly | Xaa' | Thr | Cys | Gly | Glu | Ile | Cys | Ala | Tyr | Ala | Xaa' | Ala | Cys | Xaa' | Thr | Gly | Xaa' | Cys | (SEQ ID NO: 1633) |
| Pro | Gly | Xaa' | Thr | Cys | Gly | Glu | Ile | Cys | Ala | Tyr | Ala | Xaa' | Ala | Cys | Xaa' | Thr | Gly | Cys | Xaa' | (SEQ ID NO: 1634) |
| Pro | Gly | Xaa' | Thr | Cys | Gly | Glu | Ile | Cys | Ala | Tyr | Ala | Xaa' | Ala | Cys | Thr | Xaa' | Xaa' | Gly | Cys | (SEQ ID NO: 1635) |
| Pro | Gly | Xaa' | Thr | Cys | Gly | Glu | Ile | Cys | Ala | Tyr | Ala | Xaa' | Ala | Cys | Thr | Xaa' | Gly | Xaa' | Cys | (SEQ ID NO: 1636) |

FIG. 2

```
Pro Gly Xaa' Thr Cys Gly Glu Ile Cys Ala Tyr Ala Xaa' Ala Cys Xaa' Xaa' Thr Gly Cys       (SEQID NO: 1637)
Pro Gly Xaa' Thr Cys Gly Glu Ile Cys Ala Tyr Ala Xaa' Ala Cys Xaa' Xaa' Thr Xaa' Gly Cys   (SEQID NO: 1638)
Pro Gly Xaa' Thr Cys Gly Glu Ile Cys Ala Tyr Ala Xaa' Ala Cys Xaa' Thr Gly Xaa' Cys        (SEQID NO: 1639)
Pro Gly Xaa' Thr Cys Gly Glu Ile Cys Ala Tyr Ala Xaa' Ala Cys Xaa' Thr Gly Cys Xaa'        (SEQID NO: 1640)
Pro Gly Xaa' Thr Cys Gly Glu Ile Cys Ala Tyr Ala Xaa' Ala Cys Thr Xaa' Gly Cys             (SEQID NO: 1641)
Pro Gly Xaa' Thr Cys Gly Glu Ile Cys Ala Tyr Ala Xaa' Ala Cys Thr Xaa' Xaa' Gly Cys        (SEQID NO: 1642)
Pro Gly Xaa' Thr Cys Gly Glu Ile Cys Ala Tyr Ala Xaa' Ala Cys Thr Xaa' Gly Xaa' Cys        (SEQID NO: 1643)
Pro Gly Xaa' Thr Cys Gly Glu Ile Cys Ala Tyr Ala Xaa' Ala Cys Thr Xaa' Gly Cys Xaa'        (SEQID NO: 1644)
Pro Gly Xaa' Thr Cys Gly Glu Ile Cys Ala Tyr Ala Xaa' Ala Cys Thr Gly Xaa' Cys             (SEQID NO: 1645)
Pro Gly Xaa' Thr Cys Gly Glu Ile Cys Ala Tyr Ala Xaa' Ala Cys Thr Gly Xaa' Xaa' Cys        (SEQID NO: 1646)
Pro Gly Xaa' Thr Cys Gly Glu Ile Cys Ala Tyr Ala Xaa' Ala Cys Thr Gly Xaa' Cys Xaa'        (SEQID NO: 1647)
Pro Gly Xaa' Thr Cys Gly Glu Ile Cys Ala Tyr Ala Xaa' Ala Cys Thr Gly Cys Xaa'             (SEQID NO: 1648)
Pro Gly Xaa' Thr Cys Gly Glu Ile Cys Ala Tyr Ala Xaa' Ala Cys Thr Gly Cys Xaa' Xaa'        (SEQID NO: 1649)
Pro Gly Xaa' Thr Cys Gly Glu Ile Cys Ala Tyr Ala Xaa' Ala Ala Xaa' Xaa' Cys Thr Gly Cys    (SEQID NO: 1650)
Pro Gly Xaa' Thr Cys Gly Glu Ile Cys Ala Tyr Ala Xaa' Ala Ala Xaa' Cys Xaa' Thr Gly Cys    (SEQID NO: 1651)
Pro Gly Xaa' Thr Cys Gly Glu Ile Cys Ala Tyr Ala Xaa' Ala Ala Xaa' Cys Xaa' Xaa' Thr Gly Cys (SEQID NO: 1652)
Pro Gly Xaa' Thr Cys Gly Glu Ile Cys Ala Tyr Ala Xaa' Ala Ala Xaa' Cys Xaa' Thr Xaa' Gly Cys (SEQID NO: 1653)
Pro Gly Xaa' Thr Cys Gly Glu Ile Cys Ala Tyr Ala Xaa' Ala Ala Xaa' Cys Xaa' Thr Gly Xaa' Cys (SEQID NO: 1654)
P

| | | | | | | | | | | | | |
|---|---|---|---|---|---|---|---|---|---|---|---|---|
| Pro | Gly | Xaa' | Thr | Cys | Gly | Glu | Ile | Cys | Ala | Tyr | Ala | Ala | Cys | Xaa' | Thr | Gly | Cys | (SEQ ID NO: 1671) |
| Pro | Gly | Xaa' | Thr | Cys | Gly | Glu | Ile | Cys | Ala | Tyr | Ala | Ala | Cys | Xaa' | Xaa' | Gly | Cys | (SEQ ID NO: 1672) |
| Pro | Gly | Xaa' | Thr | Cys | Gly | Glu | Ile | Cys | Ala | Tyr | Ala | Ala | Cys | Xaa' | Thr | Gly | Cys | (SEQ ID NO: 1673) |
| Pro | Gly | Xaa' | Thr | Cys | Gly | Glu | Ile | Cys | Ala | Tyr | Ala | Ala | Cys | Xaa' | Xaa' | Gly | Cys | (SEQ ID NO: 1674) |
| Pro | Gly | Xaa' | Thr | Cys | Gly | Glu | Ile | Cys | Ala | Tyr | Ala | Ala | Cys | Xaa' | Thr | Gly | Xaa' | (SEQ ID NO: 1675) |
| Pro | Gly | Xaa' | Thr | Cys | Gly | Glu | Ile | Cys | Ala | Tyr | Ala | Ala | Cys | Xaa' | Xaa' | Gly | Cys | (SEQ ID NO: 1676) |
| Pro | Gly | Xaa' | Thr | Cys | Gly | Glu | Ile | Cys | Ala | Tyr | Ala | Ala | Cys | Xaa' | Thr | Cys | Xaa' | (SEQ ID NO: 1677) |
| Pro | Gly | Xaa' | Thr | Cys | Gly | Glu | Ile | Cys | Ala | Tyr | Ala | Ala | Cys | Xaa' | Xaa' | Gly | Cys | (SEQ ID NO: 1678) |
| Pro | Gly | Xaa' | Thr | Cys | Gly | Glu | Ile | Cys | Ala | Tyr | Ala | Ala | Cys | Xaa' | Thr | Xaa' | Cys | (SEQ ID NO: 1679) |
| Pro | Gly | Xaa' | Thr | Cys | Gly | Glu | Ile | Cys | Ala | Tyr | Ala | Ala | Cys | Xaa' | Xaa' | Cys | Xaa' | (SEQ ID NO: 1680) |
| Pro | Gly | Xaa' | Thr | Cys | Gly | Glu | Ile | Cys | Ala | Tyr | Ala | Ala | Cys | Xaa' | Thr | Gly | Cys | (SEQ ID NO: 1681) |
| Pro | Gly | Xaa' | Thr | Cys | Gly | Glu | Ile | Cys | Ala | Tyr | Ala | Ala | Cys | Xaa' | Xaa' | Cys | Xaa' | (SEQ ID NO: 1682) |
| Pro | Gly | Xaa' | Thr | Cys | Gly | Glu | Ile | Cys | Ala | Tyr | Ala | Ala | Cys | Xaa' | Thr | Cys | Xaa' | (SEQ ID NO: 1683) |
| Pro | Gly | Xaa' | Thr | Cys | Gly | Glu | Ile | Cys | Ala | Tyr | Ala | Ala | Cys | Xaa' | Thr | Cys | Xaa' | (SEQ ID NO: 1684) |
| Pro | Gly | Xaa' | Thr | Cys | Gly | Glu | Ile | Cys | Ala | Tyr | Ala | Ala | Cys | Thr | Xaa' | Cys | Xaa' | (SEQ ID NO: 1685) |
| Pro | Gly | Xaa' | Thr | Cys | Gly | Glu | Ile | Cys | Ala | Tyr | Ala | Ala | Cys | Xaa' | Gly | Cys | | (SEQ ID NO: 1686) |
| Pro | Gly | Xaa' | Thr | Cys | Gly | Glu | Ile | Cys | Ala | Tyr | Ala | Ala | Cys | Thr | Xaa' | Xaa' | Gly | Cys | (SEQ ID NO: 1687) |
| Pro | Gly | Xaa' | Thr | Cys | Gly | Glu | Ile | Cys | Ala | Tyr | Ala | Ala | Cys | Thr | Xaa' | Xaa' | Gly | Cys | (SEQ ID NO: 1688) |
| Pro | Gly | Xaa' | Thr | Cys | Gly | Glu | Ile | Cys | Ala | Tyr | Ala | Ala | Cys | Thr | Xaa' | Xaa' | Gly | Xaa' | (SEQ ID NO: 1689) |
| Pro | Gly | Xaa' | Thr | Cys | Gly | Glu | Ile | Cys | Ala | Tyr | Ala | Ala | Cys | Thr | Xaa' | Xaa' | Gly | Cys | (SEQ ID NO: 1690) |
| Pro | Gly | Xaa' | Thr | Cys | Gly | Glu | Ile | Cys | Ala | Tyr | Ala | Ala | Cys | Thr | Xaa' | Gly | Xaa' | Xaa' | (SEQ ID NO: 1691) |
| Pro | Gly | Xaa' | Thr | Cys | Gly | Glu | Ile | Cys | Ala | Tyr | Ala | Ala | Cys | Thr | Xaa' | Gly | Xaa' | Cys | (SEQ ID NO: 1692) |
| Pro | Gly | Xaa' | Thr | Cys | Gly | Glu | Ile | Cys | Ala | Tyr | Ala | Ala | Cys | Thr | Xaa' | Gly | Xaa' | Xaa' | (SEQ ID NO: 1693) |
| Pro | Gly | Xaa' | Thr | Cys | Gly | Glu | Ile | Cys | Ala | Tyr | Ala | Ala | Cys | Thr | Xaa' | Gly | Cys | Xaa' | (SEQ ID NO: 1694) |
| Pro | Gly | Xaa' | Thr | Cys | Gly | Glu | Ile | Cys | Ala | Tyr | Ala | Ala | Cys | Thr | Gly | Xaa' | Xaa' | Cys | (SEQ ID NO: 1695) |
| Pro | Gly | Xaa' | Thr | Cys | Gly | Glu | Ile | Cys | Ala | Tyr | Ala | Ala | Cys | Thr | Gly | Xaa' | Xaa' | Cys | (SEQ ID NO: 1696) |
| Pro | Gly | Xaa' | Thr | Cys | Gly | Glu | Ile | Cys | Ala | Tyr | Ala | Ala | Cys | Thr | Gly | Xaa' | Xaa' | Xaa' | (SEQ ID NO: 1697) |
| Pro | Gly | Xaa' | Thr | Cys | Gly | Glu | Ile | Cys | Ala | Tyr | Ala | Ala | Cys | Thr | Gly | Xaa' | Xaa' | Cys | (SEQ ID NO: 1698) |
| Pro | Gly | Xaa' | Thr | Cys | Gly | Glu | Ile | Cys | Ala | Tyr | Ala | Ala | Cys | Thr | Gly | Xaa' | Cys | Xaa' | (SEQ ID NO: 1699) |
| Pro | Gly | Xaa' | Thr | Cys | Gly | Glu | Ile | Cys | Ala | Tyr | Ala | Ala | Cys | Thr | Gly | Cys | Xaa' | Xaa' | (SEQ ID NO: 1700) |
| Pro | Gly | Xaa' | Thr | Cys | Gly | Glu | Ile | Cys | Ala | Tyr | Ala | Ala | Cys | Thr | Gly | Cys | Xaa' | Xaa' | (SEQ ID NO: 1701) |
| Pro | Gly | Xaa' | Thr | Cys | Gly | Glu | Ile | Cys | Ala | Tyr | Ala | Ala | Cys | Thr | Gly | Cys | Xaa' | Xaa' | (SEQ ID NO: 1702) |
| Pro | Gly | Xaa' | Thr | Cys | Gly | Glu | Ile | Cys | Ala | Tyr | Ala | Ala | Cys | Thr | Gly | Cys | Xaa' | Xaa' | (SEQ ID NO: 1703) |
| Pro | Gly | Xaa' | Thr | Cys | Gly | Glu | Ile | Cys | Ala | Tyr | Ala | Ala | Cys | Thr | Gly | Cys | Xaa' | Xaa' | (SEQ ID NO: 1704) |

FIG. 2

```
Pro Gly Thr Xaa' Cys Gly Glu Ile Cys Ala Tyr Ala Ala Cys Thr Gly Cys                                    (SEQID NO: 1705)
Pro Gly Thr Xaa' Xaa' Cys Gly Glu Ile Cys Ala Tyr Ala Ala Cys Thr Gly Cys                               (SEQID NO: 1706)
Pro Gly Thr Xaa' Xaa' Xaa' Cys Gly Glu Ile Cys Ala Tyr Ala Ala Cys Thr Gly Cys                          (SEQID NO: 1707)
Pro Gly Thr Xaa' Xaa' Xaa' Xaa' Cys Gly Glu Ile Cys Ala Tyr Ala Ala Cys Thr Gly Cys                     (SEQID NO: 1708)
Pro Gly Thr Xaa' Xaa' Xaa' Cys Gly Xaa' Ile Cys Ala Tyr Ala Ala Cys Thr Gly Cys                         (SEQID NO: 1709)
Pro Gly Thr Xaa' Xaa' Xaa' Cys Gly Glu Xaa' Cys Ala Tyr Ala Ala Cys Thr Gly Cys                         (SEQID NO: 1710)
Pro Gly Thr Xaa' Xaa' Xaa' Cys Gly Glu Ile Cys Xaa' Tyr Ala Ala Cys Thr Gly Cys                         (SEQID NO: 1711)
Pro Gly Thr Xaa' Xaa' Xaa' Cys Gly Glu Ile Cys Ala Xaa' Ala Ala Cys Thr Gly Cys                         (SEQID NO: 1712)
Pro Gly Thr Xaa' Xaa' Xaa' Cys Gly Glu Ile Cys Ala Tyr Xaa' Ala Cys Thr Gly Cys                         (SEQID NO: 1713)
Pro Gly Thr Xaa' Xaa' Xaa' Cys Gly Glu Ile Cys Ala Tyr Ala Xaa' Cys Thr Gly Cys                         (SEQID NO: 1714)
Pro Gly Thr Xaa' Xaa' Xaa' Cys Gly Glu Ile Cys Ala Tyr Ala Ala Cys Xaa' Gly Cys                         (SEQID NO: 1715)
Pro Gly Thr Xaa' Xaa' Xaa' Cys Gly Glu Ile Cys Ala Tyr Ala Ala Cys Thr Xaa' Cys                         (SEQID NO: 1716)
Pro Gly Thr Xaa' Xaa' Xaa' Cys Gly Glu Ile Cys Ala Tyr Ala Ala Cys Thr Gly Xaa'                         (SEQID NO: 1717)
Pro Gly Thr Xaa' Xaa' Xaa' Cys Gly Glu Ile Cys Ala Tyr Ala Ala Xaa' Thr Gly Cys                         (SEQID NO: 1718)
Pro Gly Thr Xaa' Xaa' Xaa' Cys Gly Glu Ile Cys Ala Tyr Ala Xaa' Cys Thr Xaa' Gly Cys                    (SEQID NO: 1719)
Pro Gly Thr Xaa' Xaa' Xaa' Cys Gly Glu Ile Cys Ala Tyr Xaa' Ala Cys Thr Gly Xaa'                        (SEQID NO: 1720)
Pro Gly Thr Xaa' Xaa' Xaa' Cys Gly Glu Ile Cys Ala Xaa' Ala Ala Cys Thr Gly Cys Xaa'                    (SEQID NO: 1721)
Pro Gly Thr Xaa' Xaa' Xaa' Cys Gly Xaa' Ile Cys Ala Tyr Ala Ala Cys Thr Gly Cys                         (SEQID NO: 1722)
Pro Gly Thr Xaa' Xaa' Xaa' Cys Xaa' Gly Ile Glu Cys Ala Tyr Ala Ala Cys Thr Gly Cys                     (SEQID NO: 1723)
Pro Gly Thr Xaa' Xaa' Xaa' Cys Gly Xaa' Ile Cys Ala Tyr Ala Ala Cys Thr Gly Cys                         (SEQID NO: 1724)
Pro Gly Thr Xaa' Xaa' Xaa' Cys Gly Glu Xaa' Cys Ala Tyr Ala Ala Cys Thr Gly Cys                         (SEQID NO: 1725)
Pro Gly Thr Xaa' Xaa' Xaa' Cys Gly Glu Ile Cys Xaa' Tyr Ala Ala Cys Thr Gly Cys                         (SEQID NO: 1726)
Pro Gly Thr Xaa' Xaa' Xaa' Cys Gly Glu Ile Cys Ala Xaa' Ala Ala Cys Thr Gly Cys                         (SEQID NO: 1727)
Pro Gly Thr Xaa' Xaa' Xaa' Cys Gly Glu Ile Cys Ala Tyr Xaa' Ala Cys Thr Gly Cys                         (SEQID NO: 1728)
Pro Gly Thr Xaa' Xaa' Xaa' Cys Gly Glu Ile Cys Ala Tyr Ala Xaa' Cys Thr Gly Cys                         (SEQID NO: 1729)
Pro Gly Thr Xaa' Xaa' Xaa' Cys Gly Glu Ile Cys Ala Tyr Ala Ala Cys Xaa' Gly Cys                         (SEQID NO: 1730)
Pro Gly Thr Xaa' Xaa' Xaa' Cys Gly Glu Ile Cys Ala Tyr Ala Ala Cys Thr Xaa' Cys                         (SEQID NO: 1731)
Pro Gly Thr Xaa' Xaa' Xaa' Cys Gly Glu Ile Cys Ala Tyr Ala Ala Cys Thr Gly Xaa'                         (SEQID NO: 1732)
Pro Gly Thr Xaa' Xaa' Xaa' Cys Gly Glu Ile Cys Ala Tyr Ala Ala Xaa' Thr Gly Cys                         (SEQID NO: 1733)
Pro Gly Thr Xaa' Xaa' Xaa' Cys Gly Glu Ile Cys Ala Tyr Ala Xaa' Cys Thr Gly Cys Xaa'                    (SEQID NO: 1734)
Pro Gly Thr Xaa' Xaa' Gly Xaa' Cys Gly Glu Ile Cys Ala Tyr Ala Ala Cys Thr Gly Cys                      (SEQID NO: 1735)
Pro Gly Thr Xaa' Xaa' Xaa' Cys Gly Xaa' Xaa' Ile Cys Ala Tyr Ala Ala Cys Thr Gly Cys                    (SEQID NO: 1736)
Pro Gly Thr Xaa' Xaa' Xaa' Cys Gly Xaa' Ile Cys Ala Tyr Ala Ala Cys Thr Gly Cys                         (SEQID NO: 1737)
Pro Gly Thr Xaa' Xaa' Xaa' Cys Gly Xaa' Ile Cys Ala Tyr Ala Ala Cys Thr Gly Cys                         (SEQID NO: 1738)
```

FIG. 2

Pro Gly Thr Xaa' Xaa' Cys Gly Xaa' Glu Ile Xaa' Cys Ala Tyr Ala Ala Cys Thr Gly Cys (SEQ ID NO: 1739)
Pro Gly Thr Xaa' Xaa' Cys Gly Xaa' Glu Ile Cys Xaa' Ala Tyr Xaa' Ala Ala Cys Thr Gly Cys (SEQ ID NO: 1740)
Pro Gly Thr Xaa' Xaa' Cys Gly Xaa' Glu Ile Cys Ala Xaa' Tyr Ala Ala Cys Thr Gly Cys (SEQ ID NO: 1741)
Pro Gly Thr Xaa' Xaa' Cys Gly Xaa' Glu Ile Cys Ala Tyr Xaa' Ala Ala Cys Thr Gly Cys (SEQ ID NO: 1742)
Pro Gly Thr Xaa' Xaa' Cys Gly Xaa' Glu Ile Cys Ala Tyr Ala Xaa' Ala Cys Thr Gly Cys (SEQ ID NO: 1743)
Pro Gly Thr Xaa' Xaa' Cys Gly Xaa' Glu Ile Cys Ala Tyr Ala Ala Xaa' Cys Thr Gly Cys (SEQ ID NO: 1744)
Pro Gly Thr Xaa' Xaa' Cys Gly Xaa' Glu Ile Cys Ala Tyr Ala Ala Cys Xaa' Thr Gly Cys (SEQ ID NO: 1745)
Pro Gly Thr Xaa' Xaa' Cys Gly Xaa' Glu Ile Cys Ala Tyr Ala Ala Cys Thr Xaa' Gly Cys (SEQ ID NO: 1746)
Pro Gly Thr Xaa' Xaa' Cys Gly Xaa' Glu Ile Cys Ala Tyr Ala Ala Cys Thr Gly Xaa' Cys (SEQ ID NO: 1747)
Pro Gly Thr Xaa' Xaa' Cys Gly Xaa' Glu Ile Cys Ala Tyr Ala Ala Cys Thr Gly Cys Xaa' (SEQ ID NO: 1748)
Pro Gly Thr Xaa' Xaa' Cys Gly Glu Xaa' Ile Cys Ala Tyr Ala Ala Cys Thr Gly Cys (SEQ ID NO: 1749)
Pro Gly Thr Xaa' Xaa' Cys Gly Glu Ile Xaa' Cys Ala Tyr Ala Ala Cys Thr Gly Cys (SEQ ID NO: 1750)
Pro Gly Thr Xaa' Xaa' Cys Gly Glu Ile Cys Xaa' Ala Tyr Ala Ala Cys Thr Gly Cys (SEQ ID NO: 1751)
Pro Gly Thr Xaa' Xaa' Cys Gly Glu Ile Cys Ala Xaa' Tyr Ala Ala Cys Thr Gly Cys (SEQ ID NO: 1752)
Pro Gly Thr Xaa' Xaa' Cys Gly Glu Ile Cys Ala Tyr Xaa' Ala Ala Cys Thr Gly Cys (SEQ ID NO: 1753)
Pro Gly Thr Xaa' Xaa' Cys Gly Glu Ile Cys Ala Tyr Ala Xaa' Ala Cys Thr Gly Cys (SEQ ID NO: 1754)
Pro Gly Thr Xaa' Xaa' Cys Gly Glu Ile Cys Ala Tyr Ala Ala Xaa' Cys Thr Gly Cys (SEQ ID NO: 1755)
Pro Gly Thr Xaa' Xaa' Cys Gly Glu Ile Cys Ala Tyr Ala Ala Cys Xaa' Thr Gly Cys (SEQ ID NO: 1756)
Pro Gly Thr Xaa' Xaa' Cys Gly Glu Ile Cys Ala Tyr Ala Ala Cys Thr Xaa' Gly Cys (SEQ ID NO: 1757)
Pro Gly Thr Xaa' Xaa' Cys Gly Glu Ile Cys Ala Tyr Ala Ala Cys Thr Gly Xaa' Cys (SEQ ID NO: 1758)
Pro Gly Thr Xaa' Xaa' Cys Gly Glu Ile Cys Ala Tyr Ala Ala Cys Thr Gly Cys Xaa' (SEQ ID NO: 1759)
Pro Gly Thr Xaa' Xaa' Cys Gly Gly Glu Ile Cys Ala Tyr Ala Ala Cys Thr Gly Cys (SEQ ID NO: 1760)
Pro Gly Thr Xaa' Xaa' Cys Gly Glu Glu Ile Cys Ala Tyr Ala Ala Cys Thr Gly Cys (SEQ ID NO: 1761)
Pro Gly Thr Xaa' Xaa' Cys Gly Glu Ile Ile Cys Ala Tyr Ala Ala Cys Thr Gly Cys (SEQ ID NO: 1762)
Pro Gly Thr Xaa' Xaa' Cys Gly Glu Ile Cys Cys Ala Tyr Ala Ala Cys Thr Gly Cys (SEQ ID NO: 1763)
Pro Gly Thr Xaa' Xaa' Cys Gly Glu Ile Cys Ala Ala Tyr Ala Ala Cys Thr Gly Cys (SEQ ID NO: 1764)
Pro Gly Thr Xaa' Xaa' Cys Gly Glu Ile Cys Ala Tyr Tyr Ala Ala Cys Thr Gly Cys (SEQ ID NO: 1765)
Pro Gly Thr Xaa' Xaa' Cys Gly Glu Ile Cys Ala Tyr Ala Ala Ala Cys Thr Gly Cys (SEQ ID NO: 1766)
Pro Gly Thr Xaa' Xaa' Cys Gly Glu Ile Cys Ala Tyr Ala Ala Ala Cys Thr Gly Cys (SEQ ID NO: 1767)
Pro Gly Thr Xaa' Xaa' Cys Gly Glu Ile Cys Ala Tyr Ala Ala Cys Cys Thr Gly Cys (SEQ ID NO: 1768)
Pro Gly Thr Xaa' Xaa' Cys Gly Glu Ile Cys Ala Tyr Ala Ala Cys Thr Thr Gly Cys (SEQ ID NO: 1769)
Pro Gly Thr Xaa' Xaa' Cys Gly Glu Ile Cys Ala Tyr Ala Ala Cys Thr Gly Gly Cys (SEQ ID NO: 1770)
Pro Gly Thr Xaa' Xaa' Cys Gly Glu Ile Cys Ala Tyr Ala Ala Cys Thr Gly Cys Xaa' (SEQ ID NO: 1771)
Pro Gly Thr Xaa' Xaa' Cys Gly Glu Ile Cys Xaa' Ala Tyr Ala Ala Cys Thr Gly Cys (SEQ ID NO: 1772)

FIG. 2

```
Pro Gly Thr Xaa' Xaa' Cys Gly Glu Ile Cys Xaa' Xaa' Ala Tyr Ala Ala Cys Thr Gly Cys   (SEQ ID NO: 1773)
Pro Gly Thr Xaa' Xaa' Cys Gly Glu Ile Cys Xaa' Ala Xaa' Tyr Ala Ala Cys Thr Gly Cys   (SEQ ID NO: 1774)
Pro Gly Thr Xaa' Xaa' Cys Gly Glu Ile Cys Xaa' Ala Tyr Xaa' Ala Ala Cys Thr Gly Cys   (SEQ ID NO: 1775)
Pro Gly Thr Xaa' Xaa' Cys Gly Glu Ile Cys Xaa' Ala Tyr Ala Xaa' Ala Cys Thr Gly Cys   (SEQ ID NO: 1776)
Pro Gly Thr Xaa' Xaa' Cys Gly Glu Ile Cys Xaa' Ala Tyr Ala Ala Xaa' Cys Thr Gly Cys   (SEQ ID NO: 1777)
Pro Gly Thr Xaa' Xaa' Cys Gly Glu Ile Cys Xaa' Ala Tyr Ala Ala Cys Xaa' Thr Gly Cys   (SEQ ID NO: 1778)
Pro Gly Thr Xaa' Xaa' Cys Gly Glu Ile Cys Xaa' Ala Tyr Ala Ala Cys Thr Xaa' Gly Cys   (SEQ ID NO: 1779)
Pro Gly Thr Xaa' Xaa' Cys Gly Glu Ile Cys Xaa' Ala Tyr Ala Ala Cys Thr Gly Xaa' Cys   (SEQ ID NO: 1780)
Pro Gly Thr Xaa' Xaa' Cys Gly Glu Ile Cys Xaa' Ala Tyr Ala Ala Cys Thr Gly Cys Xaa'   (SEQ ID NO: 1781)
Pro Gly Thr Xaa' Xaa' Cys Gly Glu Ile Cys Ala Xaa' Xaa' Ala Ala Cys Thr Gly Cys       (SEQ ID NO: 1782)
Pro Gly Thr Xaa' Xaa' Cys Gly Glu Ile Cys Ala Xaa' Tyr Ala Ala Ala Cys Thr Gly Cys   (SEQ ID NO: 1783)
Pro Gly Thr Xaa' Xaa' Cys Gly Glu Ile Cys Ala Xaa' Tyr Xaa' Ala Ala Cys Thr Gly Cys   (SEQ ID NO: 1784)
Pro Gly Thr Xaa' Xaa' Cys Gly Glu Ile Cys Ala Xaa' Tyr Ala Xaa' Ala Cys Thr Gly Cys   (SEQ ID NO: 1785)
Pro Gly Thr Xaa' Xaa' Cys Gly Glu Ile Cys Ala Xaa' Tyr Ala Ala Xaa' Cys Thr Gly Cys   (SEQ ID NO: 1786)
Pro Gly Thr Xaa' Xaa' Cys Gly Glu Ile Cys Ala Xaa' Tyr Ala Ala Cys Xaa' Thr Gly Cys   (SEQ ID NO: 1787)
Pro Gly Thr Xaa' Xaa' Cys Gly Glu Ile Cys Ala Xaa' Tyr Ala Ala Cys Thr Xaa' Gly Cys   (SEQ ID NO: 1788)
Pro Gly Thr Xaa' Xaa' Cys Gly Glu Ile Cys Ala Xaa' Tyr Ala Ala Cys Thr Gly Xaa' Cys   (SEQ ID NO: 1789)
Pro Gly Thr Xaa' Xaa' Cys Gly Glu Ile Cys Ala Xaa' Tyr Ala Ala Cys Thr Gly Cys Xaa'   (SEQ ID NO: 1790)
Pro Gly Thr Xaa' Xaa' Cys Gly Glu Ile Cys Ala Tyr Xaa' Xaa' Ala Ala Cys Thr Gly Cys   (SEQ ID NO: 1791)
Pro Gly Thr Xaa' Xaa' Cys Gly Glu Ile Cys Ala Tyr Xaa' Ala Xaa' Ala Cys Thr Gly Cys   (SEQ ID NO: 1792)
Pro Gly Thr Xaa' Xaa' Cys Gly Glu Ile Cys Ala Tyr Xaa' Ala Ala Xaa' Cys Thr Gly Cys   (SEQ ID NO: 1793)
Pro Gly Thr Xaa' Xaa' Cys Gly Glu Ile Cys Ala Tyr Xaa' Ala Ala Cys Xaa' Thr Gly Cys   (SEQ ID NO: 1794)
Pro Gly Thr Xaa' Xaa' Cys Gly Glu Ile Cys Ala Tyr Xaa' Ala Ala Cys Thr Xaa' Gly Cys   (SEQ ID NO: 1795)
Pro Gly Thr Xaa' Xaa' Cys Gly Glu Ile Cys Ala Tyr Xaa' Ala Ala Cys Thr Gly Xaa' Cys   (SEQ ID NO: 1796)
Pro Gly Thr Xaa' Xaa' Cys Gly Glu Ile Cys Ala Tyr Xaa' Ala Ala Cys Thr Gly Cys Xaa'   (SEQ ID NO: 1797)
Pro Gly Thr Xaa' Xaa' Cys Gly Glu Ile Cys Ala Tyr Ala Xaa' Xaa' Ala Cys Thr Gly Cys   (SEQ ID NO: 1798)
Pro Gly Thr Xaa' Xaa' Cys Gly Glu Ile Cys Ala Tyr Ala Xaa' Ala Xaa' Cys Thr Gly Cys   (SEQ ID NO: 1799)
Pro Gly Thr Xaa' Xaa' Cys Gly Glu Ile Cys Ala Tyr Ala Xaa' Ala Cys Xaa' Thr Gly Cys   (SEQ ID NO: 1800)
Pro Gly Thr Xaa' Xaa' Cys Gly Glu Ile Cys Ala Tyr Ala Xaa' Ala Cys Thr Xaa' Gly Cys   (SEQ ID NO: 1801)
Pro Gly Thr Xaa' Xaa' Cys Gly Glu Ile Cys Ala Tyr Ala Xaa' Ala Cys Thr Gly Xaa' Cys   (SEQ ID NO: 1802)
Pro Gly Thr Xaa' Xaa' Cys Gly Glu Ile Cys Ala Tyr Ala Xaa' Ala Cys Thr Gly Cys Xaa'   (SEQ ID NO: 1803)
Pro Gly Thr Xaa' Xaa' Cys Gly Glu Ile Cys Ala Tyr Ala Ala Xaa' Xaa' Cys Thr Gly Cys   (SEQ ID NO: 1804)
Pro Gly Thr Xaa' Xaa' Cys Gly Glu Ile Cys Ala Tyr Ala Ala Xaa' Cys Thr Gly Cys Xaa'   (SEQ ID NO: 1805)
Pro Gly Thr Xaa' Xaa' Cys Gly Glu Ile Cys Ala Tyr Ala Ala Xaa' Cys Thr Gly Cys       (SEQ ID NO: 1806)
```

FIG. 2

Pro Gly Thr Xaa' Cys Gly Glu Ile Cys Ala Tyr Ala Ala Xaa' Xaa' Cys Thr Gly Cys (SEQ ID NO: 1807)
Pro Gly Thr Xaa' Cys Gly Glu Ile Cys Ala Tyr Ala Ala Xaa' Cys Xaa' Thr Gly Cys (SEQ ID NO: 1808)
Pro Gly Thr Xaa' Cys Gly Glu Ile Cys Ala Tyr Ala Ala Ala Xaa' Cys Thr Xaa' Gly Cys (SEQ ID NO: 1809)
Pro Gly Thr Xaa' Cys Gly Glu Ile Cys Ala Tyr Ala Ala Ala Xaa' Cys Thr Gly Xaa' Cys (SEQ ID NO: 1810)
Pro Gly Thr Xaa' Cys Gly Glu Ile Cys Ala Tyr Ala Ala Ala Xaa' Cys Thr Gly Cys Xaa' (SEQ ID NO: 1811)
Pro Gly Thr Xaa' Cys Gly Glu Ile Cys Ala Tyr Ala Ala Ala Cys Xaa' Thr Gly Cys (SEQ ID NO: 1812)
Pro Gly Thr Xaa' Cys Gly Glu Ile Cys Ala Tyr Ala Ala Ala Cys Xaa' Thr Xaa' Gly Cys (SEQ ID NO: 1813)
Pro Gly Thr Xaa' Cys Gly Glu Ile Cys Ala Tyr Ala Ala Ala Cys Xaa' Thr Gly Xaa' Cys (SEQ ID NO: 1814)
Pro Gly Thr Xaa' Cys Gly Glu Ile Cys Ala Tyr Ala Ala Ala Cys Xaa' Thr Gly Cys Xaa' (SEQ ID NO: 1815)
Pro Gly Thr Xaa' Cys Gly Glu Ile Cys Ala Tyr Ala Ala Ala Cys Thr Xaa' Gly Xaa' Cys (SEQ ID NO: 1816)
Pro Gly Thr Xaa' Cys Gly Glu Ile Cys Ala Tyr Ala Ala Ala Cys Thr Xaa' Gly Cys Xaa' (SEQ ID NO: 1817)
Pro Gly Thr Xaa' Cys Gly Glu Ile Cys Ala Tyr Ala Ala Ala Cys Thr Gly Xaa' Cys Xaa' (SEQ ID NO: 1818)
Pro Gly Thr Xaa' Cys Gly Glu Ile Cys Ala Tyr Ala Ala Ala Cys Thr Gly Cys Xaa' (SEQ ID NO: 1819)
Pro Gly Thr Xaa' Cys Gly Glu Ile Cys Ala Tyr Ala Ala Ala Cys Thr Gly Cys Xaa' (SEQ ID NO: 1820)
Pro Gly Thr Cys Xaa' Gly Glu Ile Cys Ala Tyr Ala Ala Ala Cys Thr Gly Xaa' Cys (SEQ ID NO: 1821)
Pro Gly Thr Cys Xaa' Gly Xaa' Glu Ile Cys Ala Tyr Ala Ala Ala Cys Thr Gly Xaa' Cys (SEQ ID NO: 1822)
Pro Gly Thr Cys Xaa' Gly Xaa' Glu Ile Cys Ala Tyr Ala Ala Ala Cys Thr Gly Xaa' Cys (SEQ ID NO: 1823)
Pro Gly Thr Cys Xaa' Gly Xaa' Glu Ile Cys Ala Tyr Ala Ala Ala Cys Thr Gly Cys Xaa' (SEQ ID NO: 1824)
Pro Gly Thr Cys Xaa' Gly Glu Ile Xaa' Cys Ala Tyr Ala Ala Ala Cys Thr Gly Cys (SEQ ID NO: 1825)
Pro Gly Thr Cys Xaa' Gly Glu Ile Cys Xaa' Ala Tyr Ala Ala Ala Cys Thr Gly Cys (SEQ ID NO: 1826)
Pro Gly Thr Cys Xaa' Gly Xaa' Glu Ile Cys Ala Tyr Ala Ala Xaa' Cys Thr Gly Cys (SEQ ID NO: 1827)
Pro Gly Thr Cys Xaa' Gly Xaa' Glu Ile Cys Ala Tyr Ala Ala Ala Cys Thr Gly Cys (SEQ ID NO: 1828)
Pro Gly Thr Cys Xaa' Gly Xaa' Glu Ile Cys Ala Tyr Ala Ala Ala Cys Thr Gly Cys (SEQ ID NO: 1829)
Pro Gly Thr Cys Xaa' Gly Xaa' Glu Ile Cys Ala Tyr Ala Ala Ala Cys Thr Gly Cys (SEQ ID NO: 1830)
Pro Gly Thr Cys Xaa' Gly Xaa' Glu Ile Cys Ala Tyr Ala Ala Ala Cys Thr Gly Cys (SEQ ID NO: 1831)
Pro Gly Thr Cys Xaa' Gly Xaa' Glu Ile Cys Xaa' Ala Tyr Ala Ala Ala Cys Thr Gly Cys (SEQ ID NO: 1832)
Pro Gly Thr Cys Xaa' Gly Xaa' Glu Ile Cys Ala Tyr Xaa' Ala Ala Ala Cys Thr Gly Cys (SEQ ID NO: 1833)
Pro Gly Thr Cys Xaa' Gly Xaa' Glu Ile Cys Ala Tyr Ala Xaa' Ala Ala Cys Thr Gly Cys (SEQ ID NO: 1834)
Pro Gly Thr Cys Xaa' Gly Xaa' Glu Ile Cys Ala Tyr Ala Ala Xaa' Ala Cys Thr Gly Cys (SEQ ID NO: 1835)
Pro Gly Thr Cys Xaa' Gly Xaa' Glu Ile Cys Ala Tyr Ala Ala Ala Xaa' Cys Thr Gly Cys (SEQ ID NO: 1836)
Pro Gly Thr Cys Xaa' Gly Xaa' Glu Ile Cys Ala Tyr Ala Ala Ala Cys Xaa' Thr Gly Cys (SEQ ID NO: 1837)
Pro Gly Thr Cys Xaa' Gly Xaa' Glu Ile Cys Ala Tyr Ala Ala Ala Cys Thr Xaa' Gly Cys (SEQ ID NO: 1838)
Pro Gly Thr Cys Xaa' Gly Xaa' Glu Ile Cys Ala Tyr Ala Ala Ala Cys Thr Gly Xaa' Cys (SEQ ID NO: 1839)
Pro Gly Thr Cys Xaa' Gly Xaa' Glu Ile Cys Ala Tyr Ala Ala Ala Cys Thr Gly Cys Xaa' (SEQ ID NO: 1840)

FIG. 2

```
Pro Gly Thr Xaa' Cys Xaa' Gly Xaa' Glu Ile Cys Ala Tyr Ala Ala Cys Thr Gly Cys    (SEQ ID NO: 1841)
Pro Gly Thr Xaa' Cys Xaa' Gly Xaa' Xaa' Glu Ile Cys Ala Tyr Ala Ala Cys Thr Gly Cys    (SEQ ID NO: 1842)
Pro Gly Thr Xaa' Cys Xaa' Gly Xaa' Glu Xaa' Ile Cys Ala Tyr Ala Ala Cys Thr Gly Cys    (SEQ ID NO: 1843)
Pro Gly Thr Xaa' Cys Xaa' Gly Xaa' Glu Ile Xaa' Cys Ala Tyr Ala Ala Cys Thr Gly Cys    (SEQ ID NO: 1844)
Pro Gly Thr Xaa' Cys Xaa' Gly Xaa' Glu Ile Cys Xaa' Ala Tyr Ala Ala Cys Thr Gly Cys    (SEQ ID NO: 1845)
Pro Gly Thr Xaa' Cys Xaa' Gly Xaa' Glu Ile Cys Ala Xaa' Tyr Ala Ala Cys Thr Gly Cys    (SEQ ID NO: 1846)
Pro Gly Thr Xaa' Cys Xaa' Gly Xaa' Glu Ile Cys Ala Tyr Xaa' Ala Ala Cys Thr Gly Cys    (SEQ ID NO: 1847)
Pro Gly Thr Xaa' Cys Xaa' Gly Xaa' Glu Ile Cys Ala Tyr Ala Xaa' Ala Cys Thr Gly Cys    (SEQ ID NO: 1848)
Pro Gly Thr Xaa' Cys Xaa' Gly Xaa' Glu Ile Cys Ala Tyr Ala Ala Xaa' Cys Thr Gly Cys    (SEQ ID NO: 1849)
Pro Gly Thr Xaa' Cys Xaa' Gly Xaa' Glu Ile Cys Ala Tyr Ala Ala Cys Xaa' Thr Gly Cys    (SEQ ID NO: 1850)
Pro Gly Thr Xaa' Cys Xaa' Gly Xaa' Glu Ile Cys Ala Tyr Ala Ala Cys Thr Xaa' Gly Cys    (SEQ ID NO: 1851)
Pro Gly Thr Xaa' Cys Xaa' Gly Xaa' Glu Ile Cys Ala Tyr Ala Ala Cys Thr Gly Xaa' Cys    (SEQ ID NO: 1852)
Pro Gly Thr Xaa' Cys Xaa' Gly Xaa' Glu Ile Cys Ala Tyr Ala Ala Cys Thr Gly Cys Xaa'    (SEQ ID NO: 1853)
Pro Gly Thr Xaa' Cys Xaa' Gly Glu Xaa' Ile Cys Ala Tyr Ala Ala Cys Thr Gly Cys    (SEQ ID NO: 1854)
Pro Gly Thr Xaa' Cys Xaa' Gly Glu Xaa' Xaa' Ile Cys Ala Tyr Ala Ala Cys Thr Gly Cys    (SEQ ID NO: 1855)
Pro Gly Thr Xaa' Cys Xaa' Gly Glu Xaa' Ile Xaa' Cys Ala Tyr Ala Ala Cys Thr Gly Cys    (SEQ ID NO: 1856)
Pro Gly Thr Xaa' Cys Xaa' Gly Glu Xaa' Ile Cys Xaa' Ala Tyr Ala Ala Cys Thr Gly Cys    (SEQ ID NO: 1857)
Pro Gly Thr Xaa' Cys Xaa' Gly Glu Xaa' Ile Cys Ala Xaa' Tyr Ala Ala Cys Thr Gly Cys    (SEQ ID NO: 1858)
Pro Gly Thr Xaa' Cys Xaa' Gly Glu Xaa' Ile Cys Ala Tyr Xaa' Ala Ala Cys Thr Gly Cys    (SEQ ID NO: 1859)
Pro Gly Thr Xaa' Cys Xaa' Gly Glu Xaa' Ile Cys Ala Tyr Ala Xaa' Ala Cys Thr Gly Cys    (SEQ ID NO: 1860)
Pro Gly Thr Xaa' Cys Xaa' Gly Glu Xaa' Ile Cys Ala Tyr Ala Ala Xaa' Cys Thr Gly Cys    (SEQ ID NO: 1861)
Pro Gly Thr Xaa' Cys Xaa' Gly Glu Xaa' Ile Cys Ala Tyr Ala Ala Cys Xaa' Thr Gly Cys    (SEQ ID NO: 1862)
Pro Gly Thr Xaa' Cys Xaa' Gly Glu Xaa' Ile Cys Ala Tyr Ala Ala Cys Thr Xaa' Gly Cys    (SEQ ID NO: 1863)
Pro Gly Thr Xaa' Cys Xaa' Gly Glu Xaa' Ile Cys Ala Tyr Ala Ala Cys Thr Gly Xaa' Cys    (SEQ ID NO: 1864)
Pro Gly Thr Xaa' Cys Xaa' Gly Glu Xaa' Ile Cys Ala Tyr Ala Ala Cys Thr Gly Cys Xaa'    (SEQ ID NO: 1865)
Pro Gly Thr Xaa' Cys Xaa' Gly Glu Ile Xaa' Cys Ala Tyr Ala Ala Cys Thr Gly Cys    (SEQ ID NO: 1866)
Pro Gly Thr Xaa' Cys Xaa' Gly Glu Ile Xaa' Xaa' Cys Ala Tyr Ala Ala Cys Thr Gly Cys    (SEQ ID NO: 1867)
Pro Gly Thr Xaa' Cys Xaa' Gly Glu Ile Xaa' Cys Xaa' Ala Tyr Ala Ala Cys Thr Gly Cys    (SEQ ID NO: 1868)
Pro Gly Thr Xaa' Cys Xaa' Gly Glu Ile Xaa' Cys Ala Xaa' Tyr Ala Ala Cys Thr Gly Cys    (SEQ ID NO: 1869)
Pro Gly Thr Xaa' Cys Xaa' Gly Glu Ile Xaa' Cys Ala Tyr Xaa' Ala Ala Cys Thr Gly Cys    (SEQ ID NO: 1870)
Pro Gly Thr Xaa' Cys Xaa' Gly Glu Ile Xaa' Cys Ala Tyr Ala Xaa' Ala Cys Thr Gly Cys    (SEQ ID NO: 1871)
Pro Gly Thr Xaa' Cys Xaa' Gly Glu Ile Xaa' Cys Ala Tyr Ala Ala Xaa' Cys Thr Gly Cys    (SEQ ID NO: 1872)
Pro Gly Thr Xaa' Cys Xaa' Gly Glu Ile Xaa' Cys Ala Tyr Ala Ala Cys Xaa' Thr Gly Cys    (SEQ ID NO: 1873)
Pro Gly Thr Xaa' Cys Xaa' Gly Glu Ile Xaa' Cys Ala Tyr Ala Ala Cys Thr Xaa' Gly Cys    (SEQ ID NO: 1874)
```

FIG. 2

| | | | | | | | | | | | |
|---|---|---|---|---|---|---|---|---|---|---|---|
| Pro Gly Thr Xaa' Cys Xaa' Gly Glu Ile Xaa' Cys Ala Tyr Ala Ala Cys Thr Gly Xaa' Cys | (SEQ ID NO: 1875) |
| Pro Gly Thr Xaa' Cys Xaa' Gly Glu Ile Ile Cys Ala Tyr Ala Ala Cys Thr Gly Cys Xaa' | (SEQ ID NO: 1876) |
| Pro Gly Thr Xaa' Cys Xaa' Gly Glu Ile Ile Cys Xaa' Ala Tyr Ala Ala Cys Thr Gly Cys | (SEQ ID NO: 1877) |
| Pro Gly Thr Xaa' Cys Xaa' Gly Glu Ile Ile Cys Xaa' Ala Xaa' Tyr Ala Ala Cys Thr Gly Cys | (SEQ ID NO: 1878) |
| Pro Gly Thr Xaa' Cys Xaa' Gly Glu Ile Ile Cys Xaa' Ala Xaa' Tyr Ala Ala Cys Thr Gly Cys | (SEQ ID NO: 1879) |
| Pro Gly Thr Xaa' Cys Xaa' Gly Glu Ile Ile Cys Xaa' Ala Xaa' Ala Tyr Ala Ala Cys Thr Gly Cys | (SEQ ID NO: 1880) |
| Pro Gly Thr Xaa' Cys Xaa' Gly Glu Ile Ile Cys Xaa' Ala Tyr Xaa' Ala Ala Cys Thr Gly Cys | (SEQ ID NO: 1881) |
| Pro Gly Thr Xaa' Cys Xaa' Gly Glu Ile Ile Cys Xaa' Ala Tyr Ala Xaa' Ala Cys Thr Gly Cys | (SEQ ID NO: 1882) |
| Pro Gly Thr Xaa' Cys Xaa' Gly Glu Ile Ile Cys Xaa' Ala Tyr Ala Ala Xaa' Cys Thr Gly Cys | (SEQ ID NO: 1883) |
| Pro Gly Thr Xaa' Cys Xaa' Gly Glu Ile Ile Cys Xaa' Ala Tyr Ala Ala Cys Xaa' Thr Gly Cys | (SEQ ID NO: 1884) |
| Pro Gly Thr Xaa' Cys Xaa' Gly Glu Ile Ile Cys Xaa' Ala Tyr Ala Ala Cys Thr Xaa' Gly Cys | (SEQ ID NO: 1885) |
| Pro Gly Thr Xaa' Cys Xaa' Gly Glu Ile Ile Cys Xaa' Ala Tyr Ala Ala Cys Thr Gly Xaa' Cys | (SEQ ID NO: 1886) |
| Pro Gly Thr Xaa' Cys Xaa' Gly Glu Ile Ile Cys Xaa' Ala Tyr Ala Ala Cys Thr Gly Cys Xaa' | (SEQ ID NO: 1887) |
| Pro Gly Thr Xaa' Cys Xaa' Gly Glu Ile Ile Cys Ala Xaa' Xaa' Tyr Ala Ala Cys Thr Gly Cys | (SEQ ID NO: 1888) |
| Pro Gly Thr Xaa' Cys Xaa' Gly Glu Ile Ile Cys Ala Xaa' Tyr Xaa' Ala Ala Cys Thr Gly Cys | (SEQ ID NO: 1889) |
| Pro Gly Thr Xaa' Cys Xaa' Gly Glu Ile Ile Cys Ala Xaa' Tyr Ala Xaa' Ala Cys Thr Gly Cys | (SEQ ID NO: 1890) |
| Pro Gly Thr Xaa' Cys Xaa' Gly Glu Ile Ile Cys Ala Xaa' Tyr Ala Ala Xaa' Cys Thr Gly Cys | (SEQ ID NO: 1891) |
| Pro Gly Thr Xaa' Cys Xaa' Gly Glu Ile Ile Cys Ala Xaa' Tyr Ala Ala Cys Xaa' Thr Gly Cys | (SEQ ID NO: 1892) |
| Pro Gly Thr Xaa' Cys Xaa' Gly Glu Ile Ile Cys Ala Xaa' Tyr Ala Ala Cys Thr Xaa' Gly Cys | (SEQ ID NO: 1893) |
| Pro Gly Thr Xaa' Cys Xaa' Gly Glu Ile Ile Cys Ala Xaa' Tyr Ala Ala Cys Thr Gly Xaa' Cys | (SEQ ID NO: 1894) |
| Pro Gly Thr Xaa' Cys Xaa' Gly Glu Ile Ile Cys Ala Xaa' Tyr Ala Ala Cys Thr Gly Cys Xaa' | (SEQ ID NO: 1895) |
| Pro Gly Thr Xaa' Cys Xaa' Gly Glu Ile Ile Cys Ala Tyr Xaa' Xaa' Ala Ala Cys Thr Gly Cys | (SEQ ID NO: 1896) |
| Pro Gly Thr Xaa' Cys Xaa' Gly Glu Ile Ile Cys Ala Tyr Xaa' Ala Xaa' Ala Cys Thr Gly Cys | (SEQ ID NO: 1897) |
| Pro Gly Thr Xaa' Cys Xaa' Gly Glu Ile Ile Cys Ala Tyr Xaa' Ala Ala Xaa' Cys Thr Gly Cys | (SEQ ID NO: 1898) |
| Pro Gly Thr Xaa' Cys Xaa' Gly Glu Ile Ile Cys Ala Tyr Xaa' Ala Ala Cys Xaa' Thr Gly Cys | (SEQ ID NO: 1899) |
| Pro Gly Thr Xaa' Cys Xaa' Gly Glu Ile Ile Cys Ala Tyr Xaa' Ala Ala Cys Thr Xaa' Gly Cys | (SEQ ID NO: 1900) |
| Pro Gly Thr Xaa' Cys Xaa' Gly Glu Ile Ile Cys Ala Tyr Xaa' Ala Ala Cys Thr Gly Xaa' Cys | (SEQ ID NO: 1901) |
| Pro Gly Thr Xaa' Cys Xaa' Gly Glu Ile Ile Cys Ala Tyr Xaa' Ala Ala Cys Thr Gly Cys Xaa' | (SEQ ID NO: 1902) |
| Pro Gly Thr Xaa' Cys Xaa' Gly Glu Ile Ile Cys Ala Tyr Ala Xaa' Xaa' Ala Cys Thr Gly Cys | (SEQ ID NO: 1903) |
| Pro Gly Thr Xaa' Cys Xaa' Gly Glu Ile Ile Cys Ala Tyr Ala Xaa' Ala Xaa' Cys Thr Gly Cys | (SEQ ID NO: 1904) |
| Pro Gly Thr Xaa' Cys Xaa' Gly Glu Ile Ile Cys Ala Tyr Ala Xaa' Ala Cys Xaa' Thr Gly Cys | (SEQ ID NO: 1905) |
| Pro Gly Thr Xaa' Cys Xaa' Gly Glu Ile Ile Cys Ala Tyr Ala Xaa' Ala Cys Thr Xaa' Gly Cys | (SEQ ID NO: 1906) |
| Pro Gly Thr Xaa' Cys Xaa' Gly Glu Ile Ile Cys Ala Tyr Ala Xaa' Ala Cys Thr Gly Xaa' Cys | (SEQ ID NO: 1907) |
| Pro Gly Thr Xaa' Cys Xaa' Gly Glu Ile Ile Cys Ala Tyr Ala Xaa' Ala Cys Thr Gly Cys Xaa' | (SEQ ID NO: 1908) |

FIG. 2

```
Pro Gly Thr Xaa' Cys Xaa' Gly Glu Ile Cys Ala Tyr Ala Xaa' Ala Cys Thr Gly Xaa' Cys       (SEQ ID NO: 1909)
Pro Gly Thr Xaa' Cys Xaa' Gly Glu Ile Cys Ala Tyr Ala Xaa' Ala Cys Thr Gly Cys Xaa'       (SEQ ID NO: 1910)
Pro Gly Thr Xaa' Cys Xaa' Gly Glu Ile Cys Ala Tyr Ala Ala Xaa' Cys Thr Gly Cys            (SEQ ID NO: 1911)
Pro Gly Thr Xaa' Cys Xaa' Gly Glu Ile Cys Ala Tyr Ala Ala Xaa' Cys Xaa' Thr Gly Cys       (SEQ ID NO: 1912)
Pro Gly Thr Xaa' Cys Xaa' Gly Glu Ile Cys Ala Tyr Ala Ala Ala Cys Xaa' Thr Gly Cys        (SEQ ID NO: 1913)
Pro Gly Thr Xaa' Cys Xaa' Gly Glu Ile Cys Ala Tyr Ala Ala Ala Cys Xaa' Thr Gly Xaa' Cys   (SEQ ID NO: 1914)
Pro Gly Thr Xaa' Cys Xaa' Gly Glu Ile Cys Ala Tyr Ala Ala Ala Cys Xaa' Thr Gly Cys Xaa'   (SEQ ID NO: 1915)
Pro Gly Thr Xaa' Cys Xaa' Gly Glu Ile Cys Ala Tyr Ala Ala Ala Xaa' Cys Thr Gly Cys Xaa'   (SEQ ID NO: 1916)
Pro Gly Thr Xaa' Cys Xaa' Gly Glu Ile Cys Ala Tyr Ala Ala Ala Xaa' Cys Xaa' Thr Gly Cys   (SEQ ID NO: 1917)
Pro Gly Thr Xaa' Cys Xaa' Gly Glu Ile Cys Ala Tyr Ala Ala Ala Cys Xaa' Xaa' Thr Gly Cys   (SEQ ID NO: 1918)
Pro Gly Thr Xaa' Cys Xaa' Gly Glu Ile Cys Ala Tyr Ala Ala Ala Cys Xaa' Thr Xaa' Gly Cys   (SEQ ID NO: 1919)
Pro Gly Thr Xaa' Cys Xaa' Gly Glu Ile Cys Ala Tyr Ala Ala Ala Cys Xaa' Thr Gly Xaa' Cys   (SEQ ID NO: 1920)
Pro Gly Thr Xaa' Cys Xaa' Gly Glu Ile Cys Ala Tyr Ala Ala Ala Cys Xaa' Thr Gly Cys Xaa'   (SEQ ID NO: 1921)
Pro Gly Thr Xaa' Cys Xaa' Gly Glu Ile Cys Ala Tyr Ala Xaa' Ala Cys Thr Xaa' Gly Cys       (SEQ ID NO: 1922)
Pro Gly Thr Xaa' Cys Xaa' Gly Glu Ile Cys Ala Tyr Ala Xaa' Ala Cys Thr Xaa' Gly Xaa' Cys  (SEQ ID NO: 1923)
Pro Gly Thr Xaa' Cys Xaa' Gly Glu Ile Cys Ala Tyr Ala Xaa' Ala Cys Thr Xaa' Gly Cys Xaa'  (SEQ ID NO: 1924)
Pro Gly Thr Xaa' Cys Xaa' Gly Glu Ile Cys Ala Tyr Ala Xaa' Ala Cys Thr Xaa' Gly Xaa' Cys Xaa' (SEQ ID NO: 1925)
Pro Gly Thr Xaa' Cys Xaa' Gly Glu Ile Cys Ala Tyr Ala Xaa' Ala Cys Thr Gly Xaa' Cys       (SEQ ID NO: 1926)
Pro Gly Thr Xaa' Cys Xaa' Gly Glu Ile Cys Ala Tyr Ala Xaa' Ala Cys Thr Gly Xaa' Xaa' Cys  (SEQ ID NO: 1927)
Pro Gly Thr Xaa' Cys Xaa' Gly Glu Ile Cys Ala Tyr Ala Xaa' Ala Cys Thr Gly Cys Xaa'       (SEQ ID NO: 1928)
Pro Gly Thr Xaa' Cys Xaa' Gly Glu Ile Cys Ala Tyr Ala Xaa' Ala Cys Thr Gly Cys Xaa' Xaa'  (SEQ ID NO: 1929)
Pro Gly Thr Xaa' Cys Xaa' Gly Glu Ile Cys Ala Tyr Ala Ala Ala Cys Thr Gly Cys             (SEQ ID NO: 1930)
Pro Gly Thr Xaa' Cys Gly Xaa' Glu Ile Cys Ala Tyr Ala Ala Ala Cys Thr Gly Cys             (SEQ ID NO: 1931)
Pro Gly Thr Xaa' Cys Gly Xaa' Xaa' Ile Cys Ala Tyr Ala Ala Ala Cys Thr Gly Cys            (SEQ ID NO: 1932)
Pro Gly Thr Xaa' Cys Gly Xaa' Xaa' Glu Ile Cys Ala Tyr Ala Ala Ala Cys Thr Gly Cys        (SEQ ID NO: 1933)
Pro Gly Thr Xaa' Cys Gly Xaa' Xaa' Glu Ile Cys Xaa' Ala Tyr Ala Ala Ala Cys Thr Gly Cys   (SEQ ID NO: 1934)
Pro Gly Thr Xaa' Cys Gly Xaa' Xaa' Glu Ile Cys Ala Xaa' Tyr Ala Ala Ala Cys Thr Gly Cys   (SEQ ID NO: 1935)
Pro Gly Thr Xaa' Cys Gly Xaa' Xaa' Glu Ile Cys Ala Tyr Xaa' Ala Ala Ala Cys Thr Gly Cys   (SEQ ID NO: 1936)
Pro Gly Thr Xaa' Cys Gly Xaa' Xaa' Glu Ile Cys Ala Tyr Ala Xaa' Ala Ala Cys Thr Gly Cys   (SEQ ID NO: 1937)
Pro Gly Thr Xaa' Cys Gly Xaa' Xaa' Glu Ile Cys Ala Tyr Ala Ala Xaa' Ala Cys Thr Gly Cys   (SEQ ID NO: 1938)
Pro Gly Thr Xaa' Cys Gly Xaa' Xaa' Glu Ile Cys Ala Tyr Ala Ala Ala Xaa' Cys Thr Gly Cys   (SEQ ID NO: 1939)
Pro Gly Thr Xaa' Cys Gly Xaa' Xaa' Glu Ile Cys Ala Tyr Ala Ala Ala Cys Xaa' Thr Gly Cys   (SEQ ID NO: 1940)
Pro Gly Thr Xaa' Cys Gly Xaa' Xaa' Glu Ile Cys Ala Tyr Ala Ala Ala Cys Thr Xaa' Gly Cys   (SEQ ID NO: 1941)
Pro Gly Thr Xaa' Cys Gly Xaa' Xaa' Glu Ile Cys Ala Tyr Ala Ala Ala Cys Thr Xaa' Gly Cys   (SEQ ID NO: 1942)
```

FIG. 2

| | | | | | | | | | | | | | |
|---|---|---|---|---|---|---|---|---|---|---|---|---|---|
| Pro | Gly | Thr | Xaa' | Cys | Gly | Xaa' | Xaa' | Glu | Ile | Cys | Ala | Tyr | Ala | Ala | Cys | Thr | Gly | Xaa' | Cys | (SEQ ID NO: 1943) |
| Pro | Gly | Thr | Xaa' | Cys | Gly | Xaa' | Xaa' | Glu | Ile | Cys | Ala | Tyr | Ala | Ala | Cys | Thr | Gly | Cys | Xaa' | (SEQ ID NO: 1944) |
| Pro | Gly | Thr | Xaa' | Cys | Gly | Xaa' | Glu | Ile | Cys | Ala | Tyr | Ala | Ala | Cys | Thr | Gly | Cys | (SEQ ID NO: 1945) |
| Pro | Gly | Thr | Xaa' | Cys | Gly | Xaa' | Xaa' | Ile | Cys | Ala | Tyr | Ala | Ala | Cys | Thr | Gly | Cys | (SEQ ID NO: 1946) |
| Pro | Gly | Thr | Xaa' | Cys | Gly | Xaa' | Xaa' | Glu | Xaa' | Cys | Ala | Tyr | Ala | Ala | Cys | Thr | Gly | Cys | (SEQ ID NO: 1947) |
| Pro | Gly | Thr | Xaa' | Cys | Gly | Xaa' | Xaa' | Glu | Ile | Xaa' | Ala | Tyr | Ala | Ala | Cys | Thr | Gly | Cys | (SEQ ID NO: 1948) |
| Pro | Gly | Thr | Xaa' | Cys | Gly | Xaa' | Xaa' | Glu | Ile | Cys | Xaa' | Tyr | Ala | Ala | Cys | Thr | Gly | Cys | (SEQ ID NO: 1949) |
| Pro | Gly | Thr | Xaa' | Cys | Gly | Xaa' | Xaa' | Glu | Ile | Cys | Ala | Xaa' | Ala | Ala | Cys | Thr | Gly | Cys | (SEQ ID NO: 1950) |
| Pro | Gly | Thr | Xaa' | Cys | Gly | Xaa' | Xaa' | Glu | Ile | Cys | Ala | Tyr | Xaa' | Ala | Cys | Thr | Gly | Cys | (SEQ ID NO: 1951) |
| Pro | Gly | Thr | Xaa' | Cys | Gly | Xaa' | Xaa' | Glu | Ile | Cys | Ala | Tyr | Ala | Xaa' | Cys | Thr | Gly | Cys | (SEQ ID NO: 1952) |
| Pro | Gly | Thr | Xaa' | Cys | Gly | Xaa' | Xaa' | Glu | Ile | Cys | Ala | Tyr | Ala | Ala | Xaa' | Thr | Gly | Cys | (SEQ ID NO: 1953) |
| Pro | Gly | Thr | Xaa' | Cys | Gly | Xaa' | Xaa' | Glu | Ile | Cys | Ala | Tyr | Ala | Ala | Cys | Xaa' | Gly | Cys | (SEQ ID NO: 1954) |
| Pro | Gly | Thr | Xaa' | Cys | Gly | Xaa' | Xaa' | Glu | Ile | Cys | Ala | Tyr | Ala | Ala | Cys | Thr | Xaa' | Cys | (SEQ ID NO: 1955) |
| Pro | Gly | Thr | Xaa' | Cys | Gly | Xaa' | Xaa' | Glu | Ile | Cys | Ala | Tyr | Ala | Ala | Cys | Thr | Gly | Xaa' | (SEQ ID NO: 1956) |
| Pro | Gly | Thr | Xaa' | Cys | Gly | Xaa' | Ile | Cys | Ala | Tyr | Ala | Ala | Cys | Thr | Gly | Cys | (SEQ ID NO: 1957) |
| Pro | Gly | Thr | Xaa' | Cys | Gly | Xaa' | Xaa' | Xaa' | Cys | Ala | Tyr | Ala | Ala | Cys | Thr | Gly | Cys | (SEQ ID NO: 1958) |
| Pro | Gly | Thr | Xaa' | Cys | Gly | Xaa' | Xaa' | Xaa' | Ile | Ala | Tyr | Ala | Ala | Cys | Thr | Gly | Cys | (SEQ ID NO: 1959) |
| Pro | Gly | Thr | Xaa' | Cys | Gly | Xaa' | Xaa' | Xaa' | Ile | Cys | Tyr | Ala | Ala | Cys | Thr | Gly | Cys | (SEQ ID NO: 1960) |
| Pro | Gly | Thr | Xaa' | Cys | Gly | Xaa' | Xaa' | Xaa' | Ile | Cys | Ala | Ala | Ala | Cys | Thr | Gly | Cys | (SEQ ID NO: 1961) |
| Pro | Gly | Thr | Xaa' | Cys | Gly | Xaa' | Xaa' | Xaa' | Ile | Cys | Ala | Tyr | Ala | Cys | Thr | Gly | Cys | (SEQ ID NO: 1962) |
| Pro | Gly | Thr | Xaa' | Cys | Gly | Xaa' | Xaa' | Xaa' | Ile | Cys | Ala | Tyr | Ala | Ala | Thr | Gly | Cys | (SEQ ID NO: 1963) |
| Pro | Gly | Thr | Xaa' | Cys | Gly | Xaa' | Xaa' | Xaa' | Ile | Cys | Ala | Tyr | Ala | Ala | Cys | Xaa' | Gly | Cys | (SEQ ID NO: 1964) |
| Pro | Gly | Thr | Xaa' | Cys | Gly | Xaa' | Xaa' | Xaa' | Ile | Cys | Ala | Tyr | Ala | Ala | Cys | Thr | Gly | Cys | (SEQ ID NO: 1965) |
| Pro | Gly | Thr | Xaa' | Cys | Gly | Xaa' | Xaa' | Xaa' | Ile | Cys | Ala | Tyr | Ala | Ala | Cys | Thr | Xaa' | Cys | (SEQ ID NO: 1966) |
| Pro | Gly | Thr | Xaa' | Cys | Gly | Xaa' | Xaa' | Xaa' | Ile | Cys | Ala | Tyr | Ala | Ala | Cys | Thr | Gly | Xaa' | (SEQ ID NO: 1967) |
| Pro | Gly | Thr | Xaa' | Cys | Gly | Xaa' | Xaa' | Cys | Ala | Tyr | Ala | Ala | Cys | Thr | Gly | Cys | (SEQ ID NO: 1968) |
| Pro | Gly | Thr | Xaa' | Cys | Gly | Xaa' | Xaa' | Xaa' | Ile | Cys | Ala | Tyr | Ala | Ala | Cys | Thr | Gly | Cys | (SEQ ID NO: 1969) |
| Pro | Gly | Thr | Xaa' | Cys | Gly | Xaa' | Xaa' | Xaa' | Ile | Cys | Ala | Tyr | Ala | Ala | Cys | Thr | Gly | Cys | (SEQ ID NO: 1970) |
| Pro | Gly | Thr | Xaa' | Cys | Gly | Xaa' | Xaa' | Xaa' | Ile | Cys | Ala | Tyr | Ala | Ala | Cys | Thr | Gly | Cys | (SEQ ID NO: 1971) |
| Pro | Gly | Thr | Xaa' | Cys | Gly | Xaa' | Xaa' | Xaa' | Ile | Cys | Ala | Tyr | Ala | Ala | Cys | Thr | Gly | Cys | (SEQ ID NO: 1972) |
| Pro | Gly | Thr | Xaa' | Cys | Gly | Xaa' | Xaa' | Xaa' | Ile | Cys | Ala | Tyr | Ala | Ala | Cys | Thr | Gly | Cys | (SEQ ID NO: 1973) |
| Pro | Gly | Thr | Xaa' | Cys | Gly | Xaa' | Xaa' | Xaa' | Ile | Cys | Ala | Tyr | Ala | Ala | Cys | Xaa' | Thr | Gly | Cys | (SEQ ID NO: 1974) |
| Pro | Gly | Thr | Xaa' | Cys | Gly | Xaa' | Xaa' | Xaa' | Ile | Cys | Ala | Tyr | Ala | Ala | Cys | Thr | Xaa' | Gly | Cys | (SEQ ID NO: 1975) |
| Pro | Gly | Thr | Xaa' | Cys | Gly | Xaa' | Xaa' | Xaa' | Ile | Cys | Ala | Tyr | Ala | Ala | Cys | Thr | Gly | Xaa' | Cys | (SEQ ID NO: 1976) |

FIG. 2

| | |
|---|---|
| Pro Gly Thr Xaa' Cys Gly Xaa' Glu Ile Cys Xaa' Ala Tyr Ala Ala Cys Thr Gly Cys Xaa' | (SEQID NO: 1977) |
| Pro Gly Thr Xaa' Cys Gly Xaa' Glu Ile Cys Ala Xaa' Tyr Ala Ala Cys Thr Gly Cys | (SEQID NO: 1978) |
| Pro Gly Thr Xaa' Cys Gly Xaa' Glu Ile Cys Ala Xaa' Xaa' Tyr Ala Ala Cys Thr Gly Cys | (SEQID NO: 1979) |
| Pro Gly Thr Xaa' Cys Gly Xaa' Glu Ile Cys Ala Xaa' Tyr Xaa' Ala Ala Cys Thr Gly Cys | (SEQID NO: 1980) |
| Pro Gly Thr Xaa' Cys Gly Xaa' Glu Ile Cys Ala Xaa' Tyr Ala Xaa' Ala Cys Thr Gly Cys | (SEQID NO: 1981) |
| Pro Gly Thr Xaa' Cys Gly Xaa' Glu Ile Cys Ala Xaa' Tyr Ala Ala Xaa' Cys Thr Gly Cys | (SEQID NO: 1982) |
| Pro Gly Thr Xaa' Cys Gly Xaa' Glu Ile Cys Ala Xaa' Tyr Ala Ala Cys Xaa' Thr Gly Cys | (SEQID NO: 1983) |
| Pro Gly Thr Xaa' Cys Gly Xaa' Glu Ile Cys Ala Xaa' Tyr Ala Ala Cys Thr Xaa' Gly Cys | (SEQID NO: 1984) |
| Pro Gly Thr Xaa' Cys Gly Xaa' Glu Ile Cys Ala Xaa' Tyr Ala Ala Cys Thr Gly Xaa' Cys | (SEQID NO: 1985) |
| Pro Gly Thr Xaa' Cys Gly Xaa' Glu Ile Cys Ala Xaa' Tyr Ala Ala Cys Thr Gly Cys Xaa' | (SEQID NO: 1986) |
| Pro Gly Thr Xaa' Cys Gly Xaa' Glu Ile Cys Xaa' Ala Tyr Xaa' Ala Ala Cys Thr Gly Cys | (SEQID NO: 1987) |
| Pro Gly Thr Xaa' Cys Gly Xaa' Glu Ile Cys Xaa' Ala Tyr Ala Xaa' Ala Cys Thr Gly Cys | (SEQID NO: 1988) |
| Pro Gly Thr Xaa' Cys Gly Xaa' Glu Ile Cys Xaa' Ala Tyr Ala Ala Xaa' Cys Thr Gly Cys | (SEQID NO: 1989) |
| Pro Gly Thr Xaa' Cys Gly Xaa' Glu Ile Cys Xaa' Ala Tyr Ala Ala Cys Xaa' Thr Gly Cys | (SEQID NO: 1990) |
| Pro Gly Thr Xaa' Cys Gly Xaa' Glu Ile Cys Xaa' Ala Tyr Ala Ala Cys Thr Xaa' Gly Cys | (SEQID NO: 1991) |
| Pro Gly Thr Xaa' Cys Gly Xaa' Glu Ile Cys Xaa' Ala Tyr Ala Ala Cys Thr Gly Xaa' Cys | (SEQID NO: 1992) |
| Pro Gly Thr Xaa' Cys Gly Xaa' Glu Ile Cys Xaa' Ala Tyr Ala Ala Cys Thr Gly Cys Xaa' | (SEQID NO: 1993) |
| Pro Gly Thr Xaa' Cys Gly Xaa' Glu Ile Cys Ala Tyr Xaa' Ala Ala Cys Thr Gly Cys | (SEQID NO: 1994) |
| Pro Gly Thr Xaa' Cys Gly Xaa' Glu Ile Cys Ala Tyr Xaa' Xaa' Ala Ala Cys Thr Gly Cys | (SEQID NO: 1995) |
| Pro Gly Thr Xaa' Cys Gly Xaa' Glu Ile Cys Ala Tyr Xaa' Ala Xaa' Ala Cys Thr Gly Cys | (SEQID NO: 1996) |
| Pro Gly Thr Xaa' Cys Gly Xaa' Glu Ile Cys Ala Tyr Xaa' Ala Ala Xaa' Cys Thr Gly Cys | (SEQID NO: 1997) |
| Pro Gly Thr Xaa' Cys Gly Xaa' Glu Ile Cys Ala Tyr Xaa' Ala Ala Cys Xaa' Thr Gly Cys | (SEQID NO: 1998) |
| Pro Gly Thr Xaa' Cys Gly Xaa' Glu Ile Cys Ala Tyr Xaa' Ala Ala Cys Thr Xaa' Gly Cys | (SEQID NO: 1999) |
| Pro Gly Thr Xaa' Cys Gly Xaa' Glu Ile Cys Ala Tyr Xaa' Ala Ala Cys Thr Gly Xaa' Cys | (SEQID NO: 2000) |
| Pro Gly Thr Xaa' Cys Gly Xaa' Glu Ile Cys Ala Tyr Xaa' Ala Ala Cys Thr Gly Cys Xaa' | (SEQID NO: 2001) |
| Pro Gly Thr Xaa' Cys Gly Xaa' Glu Ile Cys Ala Tyr Ala Xaa' Ala Cys Thr Gly Cys | (SEQID NO: 2002) |
| Pro Gly Thr Xaa' Cys Gly Xaa' Glu Ile Cys Ala Tyr Ala Xaa' Xaa' Ala Cys Thr Gly Cys | (SEQID NO: 2003) |
| Pro Gly Thr Xaa' Cys Gly Xaa' Glu Ile Cys Ala Tyr Ala Xaa' Ala Xaa' Cys Thr Gly Cys | (SEQID NO: 2004) |
| Pro Gly Thr Xaa' Cys Gly Xaa' Glu Ile Cys Ala Tyr Ala Xaa' Ala Cys Xaa' Thr Gly Cys | (SEQID NO: 2005) |
| Pro Gly Thr Xaa' Cys Gly Xaa' Glu Ile Cys Ala Tyr Ala Xaa' Ala Cys Thr Xaa' Gly Cys | (SEQID NO: 2006) |
| Pro Gly Thr Xaa' Cys Gly Xaa' Glu Ile Cys Ala Tyr Ala Xaa' Ala Cys Thr Gly Xaa' Cys | (SEQID NO: 2007) |
| Pro Gly Thr Xaa' Cys Gly Xaa' Glu Ile Cys Ala Tyr Ala Xaa' Ala Cys Thr Gly Cys Xaa' | (SEQID NO: 2008) |
| Pro Gly Thr Xaa' Cys Gly Xaa' Glu Ile Cys Ala Tyr Ala Ala Cys Xaa' Thr Gly Cys | (SEQID NO: 2009) |
| Pro Gly Thr Xaa' Cys Gly Xaa' Glu Ile Cys Ala Tyr Ala Ala Cys Xaa' Xaa' Thr Gly Cys | (SEQID NO: 2010) |

FIG. 2

| | | | | | | | | | | | | | | |
|---|---|---|---|---|---|---|---|---|---|---|---|---|---|---|
| Pro | Gly | Thr | Xaa' | Cys | Gly | Xaa' | Glu | Ile | Cys | Ala | Tyr | Ala | Ala | Cys | Xaa' | Thr | Gly | Xaa' | Cys | (SEQ ID NO: 2011) |
| Pro | Gly | Thr | Xaa' | Cys | Gly | Xaa' | Glu | Ile | Cys | Ala | Tyr | Ala | Ala | Cys | Xaa' | Thr | Gly | Cys | Xaa' | (SEQ ID NO: 2012) |
| Pro | Gly | Thr | Xaa' | Cys | Gly | Xaa' | Glu | Ile | Cys | Ala | Tyr | Ala | Ala | Cys | Thr | Gly | Xaa' | Gly | Cys | (SEQ ID NO: 2013) |
| Pro | Gly | Thr | Xaa' | Cys | Gly | Xaa' | Glu | Ile | Cys | Ala | Tyr | Ala | Ala | Cys | Thr | Xaa' | Gly | Cys | | (SEQ ID NO: 2014) |
| Pro | Gly | Thr | Xaa' | Cys | Gly | Xaa' | Glu | Ile | Cys | Ala | Tyr | Ala | Ala | Cys | Thr | Xaa' | Gly | Xaa' | Cys | (SEQ ID NO: 2015) |
| Pro | Gly | Thr | Xaa' | Cys | Gly | Xaa' | Glu | Ile | Cys | Ala | Tyr | Ala | Ala | Cys | Thr | Gly | Xaa' | Cys | Xaa' | (SEQ ID NO: 2016) |
| Pro | Gly | Thr | Xaa' | Cys | Gly | Xaa' | Glu | Ile | Cys | Ala | Tyr | Ala | Ala | Cys | Thr | Gly | Xaa' | Cys | | (SEQ ID NO: 2017) |
| Pro | Gly | Thr | Xaa' | Cys | Gly | Xaa' | Glu | Ile | Cys | Ala | Tyr | Ala | Ala | Cys | Thr | Gly | Xaa' | Xaa' | Cys | (SEQ ID NO: 2018) |
| Pro | Gly | Thr | Xaa' | Cys | Gly | Xaa' | Glu | Ile | Cys | Ala | Tyr | Ala | Ala | Cys | Thr | Gly | Xaa' | Cys | Xaa' | (SEQ ID NO: 2019) |
| Pro | Gly | Thr | Xaa' | Cys | Gly | Xaa' | Glu | Ile | Cys | Ala | Tyr | Ala | Ala | Cys | Thr | Gly | Cys | Xaa' | | (SEQ ID NO: 2020) |
| Pro | Gly | Thr | Xaa' | Cys | Gly | Xaa' | Glu | Ile | Cys | Ala | Tyr | Ala | Ala | Cys | Thr | Gly | Cys | Xaa' | Xaa' | (SEQ ID NO: 2021) |
| Pro | Gly | Thr | Xaa' | Cys | Gly | Glu | Xaa' | Ile | Cys | Ala | Tyr | Ala | Ala | Cys | Thr | Gly | Cys | | | (SEQ ID NO: 2022) |
| Pro | Gly | Thr | Xaa' | Cys | Gly | Glu | Xaa' | Xaa' | Ile | Cys | Ala | Tyr | Ala | Ala | Cys | Thr | Gly | Cys | | (SEQ ID NO: 2023) |
| Pro | Gly | Thr | Xaa' | Cys | Gly | Glu | Xaa' | Xaa' | Ile | Cys | Ala | Xaa' | Tyr | Ala | Ala | Cys | Thr | Gly | Cys | (SEQ ID NO: 2024) |
| Pro | Gly | Thr | Xaa' | Cys | Gly | Glu | Xaa' | Xaa' | Ile | Cys | Xaa' | Ala | Tyr | Ala | Ala | Cys | Thr | Gly | Cys | (SEQ ID NO: 2025) |
| Pro | Gly | Thr | Xaa' | Cys | Gly | Glu | Xaa' | Xaa' | Ile | Cys | Xaa' | Ala | Xaa' | Tyr | Ala | Ala | Cys | Thr | Gly | Cys | (SEQ ID NO: 2026) |
| Pro | Gly | Thr | Xaa' | Cys | Gly | Glu | Xaa' | Xaa' | Ile | Cys | Ala | Xaa' | Tyr | Ala | Ala | Cys | Thr | Gly | Cys | (SEQ ID NO: 2027) |
| Pro | Gly | Thr | Xaa' | Cys | Gly | Glu | Xaa' | Xaa' | Ile | Cys | Ala | Tyr | Xaa' | Ala | Ala | Cys | Thr | Gly | Cys | (SEQ ID NO: 2028) |
| Pro | Gly | Thr | Xaa' | Cys | Gly | Glu | Xaa' | Xaa' | Ile | Cys | Ala | Tyr | Ala | Xaa' | Ala | Cys | Thr | Gly | Cys | (SEQ ID NO: 2029) |
| Pro | Gly | Thr | Xaa' | Cys | Gly | Glu | Xaa' | Xaa' | Ile | Cys | Ala | Tyr | Ala | Ala | Xaa' | Cys | Thr | Gly | Cys | (SEQ ID NO: 2030) |
| Pro | Gly | Thr | Xaa' | Cys | Gly | Glu | Xaa' | Xaa' | Ile | Cys | Ala | Tyr | Ala | Ala | Cys | Xaa' | Thr | Gly | Cys | (SEQ ID NO: 2031) |
| Pro | Gly | Thr | Xaa' | Cys | Gly | Glu | Xaa' | Xaa' | Ile | Cys | Ala | Tyr | Ala | Ala | Cys | Thr | Xaa' | Gly | Cys | (SEQ ID NO: 2032) |
| Pro | Gly | Thr | Xaa' | Cys | Gly | Glu | Xaa' | Xaa' | Ile | Cys | Ala | Tyr | Ala | Ala | Cys | Thr | Gly | Xaa' | Cys | (SEQ ID NO: 2033) |
| Pro | Gly | Thr | Xaa' | Cys | Gly | Glu | Xaa' | Xaa' | Ile | Cys | Ala | Tyr | Ala | Ala | Cys | Thr | Gly | Cys | Xaa' | (SEQ ID NO: 2034) |
| Pro | Gly | Thr | Xaa' | Cys | Gly | Glu | Xaa' | Ile | Xaa' | Cys | Ala | Tyr | Ala | Ala | Cys | Thr | Gly | Cys | | (SEQ ID NO: 2035) |
| Pro | Gly | Thr | Xaa' | Cys | Gly | Glu | Xaa' | Ile | Cys | Xaa' | Ala | Tyr | Ala | Ala | Cys | Thr | Gly | Cys | | (SEQ ID NO: 2036) |
| Pro | Gly | Thr | Xaa' | Cys | Gly | Glu | Xaa' | Ile | Cys | Ala | Xaa' | Tyr | Ala | Ala | Cys | Thr | Gly | Cys | | (SEQ ID NO: 2037) |
| Pro | Gly | Thr | Xaa' | Cys | Gly | Glu | Xaa' | Ile | Cys | Ala | Tyr | Xaa' | Ala | Ala | Cys | Thr | Gly | Cys | | (SEQ ID NO: 2038) |
| Pro | Gly | Thr | Xaa' | Cys | Gly | Glu | Xaa' | Ile | Cys | Ala | Tyr | Ala | Xaa' | Ala | Cys | Thr | Gly | Cys | | (SEQ ID NO: 2039) |
| Pro | Gly | Thr | Xaa' | Cys | Gly | Glu | Xaa' | Ile | Cys | Ala | Tyr | Ala | Ala | Xaa' | Cys | Thr | Gly | Cys | | (SEQ ID NO: 2040) |
| Pro | Gly | Thr | Xaa' | Cys | Gly | Glu | Xaa' | Ile | Cys | Ala | Tyr | Ala | Ala | Cys | Xaa' | Thr | Gly | Cys | | (SEQ ID NO: 2041) |
| Pro | Gly | Thr | Xaa' | Cys | Gly | Glu | Xaa' | Ile | Cys | Ala | Tyr | Ala | Ala | Cys | Thr | Xaa' | Gly | Cys | | (SEQ ID NO: 2042) |
| Pro | Gly | Thr | Xaa' | Cys | Gly | Glu | Xaa' | Ile | Cys | Ala | Tyr | Ala | Ala | Cys | Thr | Gly | Xaa' | Cys | | (SEQ ID NO: 2043) |
| Pro | Gly | Thr | Xaa' | Cys | Gly | Glu | Xaa' | Ile | Cys | Ala | Tyr | Ala | Ala | Cys | Thr | Gly | Cys | Xaa' | | (SEQ ID NO: 2044) |

FIG. 2

| | | |
|---|---|---|
| Pro Gly Thr Xaa' Cys Gly Glu Xaa' Ile Xaa' Cys Ala Tyr Ala Ala Cys Thr Gly Cys Xaa' | (SEQ ID NO: 2045) |
| Pro Gly Thr Xaa' Cys Gly Glu Xaa' Ile Cys Xaa' Ala Ala Tyr Ala Ala Cys Thr Gly Cys | (SEQ ID NO: 2046) |
| Pro Gly Thr Xaa' Cys Gly Glu Xaa' Ile Cys Xaa' Ala Xaa' Tyr Ala Ala Cys Thr Gly Cys | (SEQ ID NO: 2047) |
| Pro Gly Thr Xaa' Cys Gly Glu Xaa' Ile Cys Xaa' Ala Ala Xaa' Ala Ala Cys Thr Gly Cys | (SEQ ID NO: 2048) |
| Pro Gly Thr Xaa' Cys Gly Glu Xaa' Ile Cys Xaa' Ala Ala Tyr Xaa' Ala Cys Thr Gly Cys | (SEQ ID NO: 2049) |
| Pro Gly Thr Xaa' Cys Gly Glu Xaa' Ile Cys Xaa' Ala Ala Tyr Ala Xaa' Cys Thr Gly Cys | (SEQ ID NO: 2050) |
| Pro Gly Thr Xaa' Cys Gly Glu Xaa' Ile Cys Xaa' Ala Ala Tyr Ala Ala Cys Xaa' Gly Cys | (SEQ ID NO: 2051) |
| Pro Gly Thr Xaa' Cys Gly Glu Xaa' Ile Cys Xaa' Ala Ala Tyr Ala Ala Cys Thr Xaa' Cys | (SEQ ID NO: 2052) |
| Pro Gly Thr Xaa' Cys Gly Glu Xaa' Ile Cys Xaa' Ala Ala Tyr Ala Ala Cys Thr Gly Xaa' | (SEQ ID NO: 2053) |
| Pro Gly Thr Xaa' Cys Gly Glu Xaa' Ile Cys Ala Xaa' Ala Tyr Ala Ala Cys Thr Gly Cys | (SEQ ID NO: 2054) |
| Pro Gly Thr Xaa' Cys Gly Glu Xaa' Ile Cys Ala Ala Xaa' Tyr Ala Ala Cys Thr Gly Cys | (SEQ ID NO: 2055) |
| Pro Gly Thr Xaa' Cys Gly Glu Xaa' Ile Cys Ala Ala Tyr Xaa' Ala Ala Cys Thr Gly Cys Xaa' | (SEQ ID NO: 2056) |
| Pro Gly Thr Xaa' Cys Gly Glu Xaa' Ile Cys Ala Xaa' Xaa' Tyr Ala Ala Cys Thr Gly Cys | (SEQ ID NO: 2057) |
| Pro Gly Thr Xaa' Cys Gly Glu Xaa' Ile Cys Ala Xaa' Ala Xaa' Ala Ala Cys Thr Gly Cys | (SEQ ID NO: 2058) |
| Pro Gly Thr Xaa' Cys Gly Glu Xaa' Ile Cys Ala Xaa' Ala Tyr Xaa' Ala Cys Thr Gly Cys | (SEQ ID NO: 2059) |
| Pro Gly Thr Xaa' Cys Gly Glu Xaa' Ile Cys Ala Xaa' Ala Tyr Ala Xaa' Cys Thr Gly Cys | (SEQ ID NO: 2060) |
| Pro Gly Thr Xaa' Cys Gly Glu Xaa' Ile Cys Ala Xaa' Ala Tyr Ala Ala Cys Xaa' Gly Cys | (SEQ ID NO: 2061) |
| Pro Gly Thr Xaa' Cys Gly Glu Xaa' Ile Cys Ala Xaa' Ala Tyr Ala Ala Cys Thr Xaa' Cys | (SEQ ID NO: 2062) |
| Pro Gly Thr Xaa' Cys Gly Glu Xaa' Ile Cys Ala Xaa' Ala Tyr Ala Ala Cys Thr Gly Xaa' | (SEQ ID NO: 2063) |
| Pro Gly Thr Xaa' Cys Gly Glu Xaa' Ile Cys Ala Ala Xaa' Tyr Xaa' Ala Cys Thr Gly Cys | (SEQ ID NO: 2064) |
| Pro Gly Thr Xaa' Cys Gly Glu Xaa' Ile Cys Ala Ala Xaa' Tyr Ala Xaa' Cys Thr Gly Cys | (SEQ ID NO: 2065) |
| Pro Gly Thr Xaa' Cys Gly Glu Xaa' Ile Cys Ala Ala Xaa' Tyr Ala Ala Cys Xaa' Gly Cys | (SEQ ID NO: 2066) |
| Pro Gly Thr Xaa' Cys Gly Glu Xaa' Ile Cys Ala Ala Xaa' Tyr Ala Ala Cys Thr Xaa' Cys | (SEQ ID NO: 2067) |
| Pro Gly Thr Xaa' Cys Gly Glu Xaa' Ile Cys Ala Ala Xaa' Tyr Ala Ala Cys Thr Gly Xaa' | (SEQ ID NO: 2068) |
| Pro Gly Thr Xaa' Cys Gly Glu Xaa' Ile Cys Ala Ala Tyr Xaa' Xaa' Ala Cys Thr Gly Cys | (SEQ ID NO: 2069) |
| Pro Gly Thr Xaa' Cys Gly Glu Xaa' Ile Cys Ala Ala Tyr Xaa' Ala Xaa' Cys Thr Gly Cys | (SEQ ID NO: 2070) |
| Pro Gly Thr Xaa' Cys Gly Glu Xaa' Ile Cys Ala Ala Tyr Xaa' Ala Ala Cys Xaa' Gly Cys | (SEQ ID NO: 2071) |
| Pro Gly Thr Xaa' Cys Gly Glu Xaa' Ile Cys Ala Ala Tyr Xaa' Ala Ala Cys Thr Xaa' Cys | (SEQ ID NO: 2072) |
| Pro Gly Thr Xaa' Cys Gly Glu Xaa' Ile Cys Ala Ala Tyr Xaa' Ala Ala Cys Thr Gly Xaa' | (SEQ ID NO: 2073) |
| Pro Gly Thr Xaa' Cys Gly Glu Xaa' Ile Cys Ala Ala Tyr Ala Xaa' Xaa' Cys Thr Gly Cys | (SEQ ID NO: 2074) |
| Pro Gly Thr Xaa' Cys Gly Glu Xaa' Ile Cys Ala Ala Tyr Ala Xaa' Ala Cys Xaa' Gly Cys | (SEQ ID NO: 2075) |
| Pro Gly Thr Xaa' Cys Gly Glu Xaa' Ile Cys Ala Ala Tyr Ala Xaa' Ala Cys Thr Xaa' Cys | (SEQ ID NO: 2076) |
| Pro Gly Thr Xaa' Cys Gly Glu Xaa' Ile Cys Ala Ala Tyr Ala Ala Cys Thr Xaa' Gly Cys | (SEQ ID NO: 2077) |
| Pro Gly Thr Xaa' Cys Gly Glu Xaa' Ile Cys Ala Ala Tyr Ala Ala Cys Thr Gly Xaa' Cys | (SEQ ID NO: 2078) |

FIG. 2

| Sequence | SEQ ID NO |
|---|---|
| Pro Gly Thr Xaa' Cys Gly Glu Xaa' Ile Cys Ala Tyr Ala Xaa' Ala Cys Thr Gly Cys Xaa' | (SEQ ID NO: 2079) |
| Pro Gly Thr Xaa' Cys Gly Glu Xaa' Ile Cys Ala Tyr Ala Ala Xaa' Cys Thr Gly Cys | (SEQ ID NO: 2080) |
| Pro Gly Thr Xaa' Cys Gly Glu Xaa' Ile Cys Ala Tyr Ala Ala Ala Xaa' Cys Thr Gly Cys | (SEQ ID NO: 2081) |
| Pro Gly Thr Xaa' Cys Gly Glu Xaa' Ile Cys Ala Tyr Ala Ala Xaa' Cys Xaa' Thr Gly Cys | (SEQ ID NO: 2082) |
| Pro Gly Thr Xaa' Cys Gly Glu Xaa' Ile Cys Ala Tyr Ala Ala Xaa' Cys Thr Xaa' Gly Cys | (SEQ ID NO: 2083) |
| Pro Gly Thr Xaa' Cys Gly Glu Xaa' Ile Cys Ala Tyr Ala Ala Xaa' Cys Thr Gly Xaa' Cys | (SEQ ID NO: 2084) |
| Pro Gly Thr Xaa' Cys Gly Glu Xaa' Ile Cys Ala Tyr Ala Ala Xaa' Cys Thr Gly Cys Xaa' | (SEQ ID NO: 2085) |
| Pro Gly Thr Xaa' Cys Gly Glu Xaa' Ile Cys Ala Tyr Ala Ala Ala Cys Xaa' Thr Gly Cys | (SEQ ID NO: 2086) |
| Pro Gly Thr Xaa' Cys Gly Glu Xaa' Ile Cys Ala Tyr Ala Ala Ala Cys Xaa' Thr Gly Cys | (SEQ ID NO: 2087) |
| Pro Gly Thr Xaa' Cys Gly Glu Xaa' Ile Cys Ala Tyr Ala Ala Ala Cys Thr Xaa' Gly Cys | (SEQ ID NO: 2088) |
| Pro Gly Thr Xaa' Cys Gly Glu Xaa' Ile Cys Ala Tyr Ala Ala Ala Cys Thr Gly Xaa' Cys | (SEQ ID NO: 2089) |
| Pro Gly Thr Xaa' Cys Gly Glu Xaa' Ile Cys Ala Tyr Ala Ala Ala Cys Thr Gly Cys Xaa' | (SEQ ID NO: 2090) |
| Pro Gly Thr Xaa' Cys Gly Glu Xaa' Ile Cys Ala Tyr Ala Ala Ala Cys Thr Gly Cys | (SEQ ID NO: 2091) |
| Pro Gly Thr Xaa' Cys Gly Glu Xaa' Ile Cys Ala Tyr Ala Xaa' Xaa' Cys Thr Gly Cys | (SEQ ID NO: 2092) |
| Pro Gly Thr Xaa' Cys Gly Glu Xaa' Ile Cys Ala Tyr Ala Xaa' Ala Cys Xaa' Thr Gly Cys | (SEQ ID NO: 2093) |
| Pro Gly Thr Xaa' Cys Gly Glu Xaa' Ile Cys Ala Tyr Ala Xaa' Ala Cys Thr Xaa' Gly Cys | (SEQ ID NO: 2094) |
| Pro Gly Thr Xaa' Cys Gly Glu Xaa' Ile Cys Ala Tyr Ala Xaa' Ala Cys Thr Gly Xaa' Cys | (SEQ ID NO: 2095) |
| Pro Gly Thr Xaa' Cys Gly Glu Xaa' Ile Cys Ala Tyr Ala Xaa' Ala Cys Thr Gly Cys Xaa' | (SEQ ID NO: 2096) |
| Pro Gly Thr Xaa' Cys Gly Glu Xaa' Ile Cys Ala Tyr Ala Xaa' Ala Xaa' Cys Thr Gly Cys | (SEQ ID NO: 2097) |
| Pro Gly Thr Xaa' Cys Gly Glu Xaa' Ile Cys Ala Tyr Ala Xaa' Ala Cys Thr Gly Cys Xaa' | (SEQ ID NO: 2098) |
| Pro Gly Thr Xaa' Cys Gly Glu Ile Xaa' Cys Ala Tyr Ala Ala Ala Cys Thr Gly Cys | (SEQ ID NO: 2099) |
| Pro Gly Thr Xaa' Cys Gly Glu Ile Xaa' Xaa' Ala Tyr Ala Ala Ala Cys Thr Gly Cys | (SEQ ID NO: 2100) |
| Pro Gly Thr Xaa' Cys Gly Glu Xaa' Ile Xaa' Xaa' Ala Tyr Ala Ala Cys Thr Gly Cys | (SEQ ID NO: 2101) |
| Pro Gly Thr Xaa' Cys Gly Glu Xaa' Ile Xaa' Xaa' Cys Ala Tyr Ala Ala Ala Cys Thr Gly Cys | (SEQ ID NO: 2102) |
| Pro Gly Thr Xaa' Cys Gly Glu Xaa' Ile Xaa' Xaa' Cys Ala Xaa' Ala Tyr Ala Ala Cys Thr Gly Cys | (SEQ ID NO: 2103) |
| Pro Gly Thr Xaa' Cys Gly Glu Xaa' Ile Xaa' Xaa' Cys Ala Xaa' Ala Tyr Ala Ala Cys Thr Gly Cys | (SEQ ID NO: 2104) |
| Pro Gly Thr Xaa' Cys Gly Glu Xaa' Ile Xaa' Xaa' Cys Ala Xaa' Ala Tyr Ala Ala Cys Thr Gly Cys | (SEQ ID NO: 2105) |
| Pro Gly Thr Xaa' Cys Gly Glu Xaa' Ile Xaa' Cys Ala Xaa' Ala Tyr Ala Ala Xaa' Cys Thr Gly Cys | (SEQ ID NO: 2106) |
| Pro Gly Thr Xaa' Cys Gly Glu Xaa' Ile Xaa' Cys Ala Xaa' Ala Tyr Ala Ala Cys Xaa' Thr Gly Cys | (SEQ ID NO: 2107) |
| Pro Gly Thr Xaa' Cys Gly Glu Xaa' Ile Xaa' Cys Ala Xaa' Ala Tyr Ala Ala Cys Thr Xaa' Gly Cys | (SEQ ID NO: 2108) |
| Pro Gly Thr Xaa' Cys Gly Glu Xaa' Ile Xaa' Cys Ala Xaa' Ala Tyr Ala Ala Cys Thr Gly Xaa' Cys | (SEQ ID NO: 2109) |
| Pro Gly Thr Xaa' Cys Gly Glu Xaa' Ile Xaa' Cys Ala Xaa' Ala Tyr Ala Ala Cys Thr Gly Cys Xaa' | (SEQ ID NO: 2110) |
| Pro Gly Thr Xaa' Cys Gly Glu Xaa' Ile Xaa' Cys Xaa' Ala Tyr Ala Ala Ala Cys Thr Gly Cys | (SEQ ID NO: 2111) |
| Pro Gly Thr Xaa' Cys Gly Glu Ile Xaa' Cys Xaa' Ala Tyr Ala Ala Ala Cys Thr Gly Cys | (SEQ ID NO: 2112) |

FIG. 2

```
Pro Gly Thr Xaa' Cys Gly Glu Ile Xaa' Cys Xaa' Xaa' Ala Tyr Ala Ala Cys Thr Gly Cys     (SEQ ID NO: 2113)
Pro Gly Thr Xaa' Cys Gly Glu Ile Xaa' Cys Xaa' Ala Xaa' Tyr Ala Ala Cys Thr Gly Cys      (SEQ ID NO: 2114)
Pro Gly Thr Xaa' Cys Gly Glu Ile Xaa' Cys Xaa' Ala Tyr Xaa' Ala Ala Cys Thr Gly Cys      (SEQ ID NO: 2115)
Pro Gly Thr Xaa' Cys Gly Glu Ile Xaa' Cys Xaa' Ala Tyr Ala Xaa' Ala Cys Thr Gly Cys      (SEQ ID NO: 2116)
Pro Gly Thr Xaa' Cys Gly Glu Ile Xaa' Cys Xaa' Ala Tyr Ala Ala Xaa' Cys Thr Gly Cys      (SEQ ID NO: 2117)
Pro Gly Thr Xaa' Cys Gly Glu Ile Xaa' Cys Xaa' Ala Tyr Ala Ala Cys Xaa' Thr Gly Cys      (SEQ ID NO: 2118)
Pro Gly Thr Xaa' Cys Gly Glu Ile Xaa' Cys Xaa' Ala Tyr Ala Ala Cys Thr Xaa' Gly Cys      (SEQ ID NO: 2119)
Pro Gly Thr Xaa' Cys Gly Glu Ile Xaa' Cys Xaa' Ala Tyr Ala Ala Cys Thr Gly Xaa' Cys      (SEQ ID NO: 2120)
Pro Gly Thr Xaa' Cys Gly Glu Ile Xaa' Cys Xaa' Ala Tyr Ala Ala Cys Thr Gly Cys Xaa'      (SEQ ID NO: 2121)
Pro Gly Thr Xaa' Cys Gly Glu Ile Xaa' Cys Ala Xaa' Xaa' Tyr Ala Ala Cys Thr Gly Cys      (SEQ ID NO: 2122)
Pro Gly Thr Xaa' Cys Gly Glu Ile Xaa' Cys Ala Xaa' Tyr Xaa' Ala Ala Cys Thr Gly Cys      (SEQ ID NO: 2123)
Pro Gly Thr Xaa' Cys Gly Glu Ile Xaa' Cys Ala Xaa' Tyr Ala Xaa' Ala Cys Thr Gly Cys      (SEQ ID NO: 2124)
Pro Gly Thr Xaa' Cys Gly Glu Ile Xaa' Cys Ala Xaa' Tyr Ala Ala Xaa' Cys Thr Gly Cys      (SEQ ID NO: 2125)
Pro Gly Thr Xaa' Cys Gly Glu Ile Xaa' Cys Ala Xaa' Tyr Ala Ala Cys Xaa' Thr Gly Cys      (SEQ ID NO: 2126)
Pro Gly Thr Xaa' Cys Gly Glu Ile Xaa' Cys Ala Xaa' Tyr Ala Ala Cys Thr Xaa' Gly Cys      (SEQ ID NO: 2127)
Pro Gly Thr Xaa' Cys Gly Glu Ile Xaa' Cys Ala Xaa' Tyr Ala Ala Cys Thr Gly Xaa' Cys      (SEQ ID NO: 2128)
Pro Gly Thr Xaa' Cys Gly Glu Ile Xaa' Cys Ala Xaa' Tyr Ala Ala Cys Thr Gly Cys Xaa'      (SEQ ID NO: 2129)
Pro Gly Thr Xaa' Cys Gly Glu Ile Xaa' Cys Ala Tyr Xaa' Xaa' Ala Ala Cys Thr Gly Cys      (SEQ ID NO: 2130)
Pro Gly Thr Xaa' Cys Gly Glu Ile Xaa' Cys Ala Tyr Xaa' Ala Xaa' Ala Cys Thr Gly Cys      (SEQ ID NO: 2131)
Pro Gly Thr Xaa' Cys Gly Glu Ile Xaa' Cys Ala Tyr Xaa' Ala Ala Xaa' Cys Thr Gly Cys      (SEQ ID NO: 2132)
Pro Gly Thr Xaa' Cys Gly Glu Ile Xaa' Cys Ala Tyr Xaa' Ala Ala Cys Xaa' Thr Gly Cys      (SEQ ID NO: 2133)
Pro Gly Thr Xaa' Cys Gly Glu Ile Xaa' Cys Ala Tyr Xaa' Ala Ala Cys Thr Xaa' Gly Cys      (SEQ ID NO: 2134)
Pro Gly Thr Xaa' Cys Gly Glu Ile Xaa' Cys Ala Tyr Xaa' Ala Ala Cys Thr Gly Xaa' Cys      (SEQ ID NO: 2135)
Pro Gly Thr Xaa' Cys Gly Glu Ile Xaa' Cys Ala Tyr Xaa' Ala Ala Cys Thr Gly Cys Xaa'      (SEQ ID NO: 2136)
Pro Gly Thr Xaa' Cys Gly Glu Ile Xaa' Cys Ala Tyr Ala Xaa' Xaa' Ala Cys Thr Gly Cys      (SEQ ID NO: 2137)
Pro Gly Thr Xaa' Cys Gly Glu Ile Xaa' Cys Ala Tyr Ala Xaa' Ala Xaa' Cys Thr Gly Cys      (SEQ ID NO: 2138)
Pro Gly Thr Xaa' Cys Gly Glu Ile Xaa' Cys Ala Tyr Ala Xaa' Ala Cys Xaa' Thr Gly Cys      (SEQ ID NO: 2139)
Pro Gly Thr Xaa' Cys Gly Glu Ile Xaa' Cys Ala Tyr Ala Xaa' Ala Cys Thr Xaa' Gly Cys      (SEQ ID NO: 2140)
Pro Gly Thr Xaa' Cys Gly Glu Ile Xaa' Cys Ala Tyr Ala Xaa' Ala Cys Thr Gly Xaa' Cys      (SEQ ID NO: 2141)
Pro Gly Thr Xaa' Cys Gly Glu Ile Xaa' Cys Ala Tyr Ala Xaa' Ala Cys Thr Gly Cys Xaa'      (SEQ ID NO: 2142)
Pro Gly Thr Xaa' Cys Gly Glu Ile Xaa' Cys Ala Tyr Ala Ala Xaa' Xaa' Cys Thr Gly Cys      (SEQ ID NO: 2143)
Pro Gly Thr Xaa' Cys Gly Glu Ile Xaa' Cys Ala Tyr Ala Ala Xaa' Cys Thr Gly Xaa' Cys      (SEQ ID NO: 2144)
Pro Gly Thr Xaa' Cys Gly Glu Ile Xaa' Cys Ala Tyr Ala Ala Xaa' Cys Thr Gly Cys Xaa'      (SEQ ID NO: 2145)
Pro Gly Thr Xaa' Cys Gly Glu Ile Xaa' Cys Ala Tyr Ala Ala Xaa' Ala Cys Thr Gly Cys      (SEQ ID NO: 2146)
```

FIG. 2

| | |
|---|---|
| Pro Gly Thr Xaa' Cys Gly Glu Ile Xaa' Cys Ala Tyr Ala Ala Xaa' Xaa' Cys Thr Gly Cys | (SEQ ID NO: 2147) |
| Pro Gly Thr Xaa' Cys Gly Glu Ile Xaa' Cys Ala Tyr Ala Ala Xaa' Cys Xaa' Thr Gly Cys | (SEQ ID NO: 2148) |
| Pro Gly Thr Xaa' Cys Gly Glu Ile Xaa' Cys Ala Tyr Ala Ala Xaa' Cys Thr Xaa' Gly Cys | (SEQ ID NO: 2149) |
| Pro Gly Thr Xaa' Cys Gly Glu Ile Xaa' Cys Ala Tyr Ala Ala Xaa' Cys Thr Gly Xaa' Cys | (SEQ ID NO: 2150) |
| Pro Gly Thr Xaa' Cys Gly Glu Ile Xaa' Cys Ala Tyr Ala Ala Xaa' Cys Thr Gly Cys Xaa' | (SEQ ID NO: 2151) |
| Pro Gly Thr Xaa' Cys Gly Glu Ile Xaa' Cys Ala Tyr Ala Ala Cys Xaa' Xaa' Thr Gly Cys | (SEQ ID NO: 2152) |
| Pro Gly Thr Xaa' Cys Gly Glu Ile Xaa' Cys Ala Tyr Ala Ala Cys Xaa' Thr Xaa' Gly Cys | (SEQ ID NO: 2153) |
| Pro Gly Thr Xaa' Cys Gly Glu Ile Xaa' Cys Ala Tyr Ala Ala Cys Xaa' Thr Gly Xaa' Cys | (SEQ ID NO: 2154) |
| Pro Gly Thr Xaa' Cys Gly Glu Ile Xaa' Cys Ala Tyr Ala Ala Cys Xaa' Thr Gly Xaa' Cys | (SEQ ID NO: 2155) |
| Pro Gly Thr Xaa' Cys Gly Glu Ile Xaa' Cys Ala Tyr Ala Ala Cys Xaa' Thr Gly Cys Xaa' | (SEQ ID NO: 2156) |
| Pro Gly Thr Xaa' Cys Gly Glu Ile Xaa' Cys Ala Tyr Ala Ala Cys Thr Xaa' Xaa' Gly Cys | (SEQ ID NO: 2157) |
| Pro Gly Thr Xaa' Cys Gly Glu Ile Xaa' Cys Ala Tyr Ala Ala Cys Thr Xaa' Gly Xaa' Cys | (SEQ ID NO: 2158) |
| Pro Gly Thr Xaa' Cys Gly Glu Ile Xaa' Cys Ala Tyr Ala Ala Cys Thr Xaa' Gly Cys Xaa' | (SEQ ID NO: 2159) |
| Pro Gly Thr Xaa' Cys Gly Glu Ile Xaa' Cys Ala Tyr Ala Ala Cys Thr Gly Xaa' Cys Xaa' | (SEQ ID NO: 2160) |
| Pro Gly Thr Xaa' Cys Gly Glu Ile Cys Xaa' Xaa' Ala Tyr Ala Ala Xaa' Cys Thr Gly Cys | (SEQ ID NO: 2161) |
| Pro Gly Thr Xaa' Cys Gly Glu Ile Cys Xaa' Ala Xaa' Tyr Ala Ala Xaa' Cys Thr Gly Cys | (SEQ ID NO: 2162) |
| Pro Gly Thr Xaa' Cys Gly Glu Ile Cys Xaa' Ala Tyr Xaa' Ala Ala Xaa' Cys Thr Gly Cys | (SEQ ID NO: 2163) |
| Pro Gly Thr Xaa' Cys Gly Glu Ile Cys Xaa' Ala Tyr Ala Xaa' Ala Xaa' Cys Thr Gly Cys | (SEQ ID NO: 2164) |
| Pro Gly Thr Xaa' Cys Gly Glu Ile Cys Xaa' Ala Tyr Ala Ala Xaa' Cys Thr Gly Cys Xaa' | (SEQ ID NO: 2165) |
| Pro Gly Thr Xaa' Cys Gly Glu Ile Cys Xaa' Ala Tyr Ala Ala Cys Thr Gly Cys | (SEQ ID NO: 2166) |
| Pro Gly Thr Xaa' Cys Gly Glu Ile Cys Xaa' Xaa' Ala Xaa' Tyr Ala Ala Cys Thr Gly Cys | (SEQ ID NO: 2167) |
| Pro Gly Thr Xaa' Cys Gly Glu Ile Cys Xaa' Xaa' Ala Tyr Xaa' Ala Ala Cys Thr Gly Cys | (SEQ ID NO: 2168) |
| Pro Gly Thr Xaa' Cys Gly Glu Ile Cys Xaa' Xaa' Ala Tyr Ala Xaa' Ala Cys Thr Gly Cys | (SEQ ID NO: 2169) |
| Pro Gly Thr Xaa' Cys Gly Glu Ile Cys Xaa' Xaa' Ala Tyr Ala Ala Xaa' Cys Thr Gly Cys | (SEQ ID NO: 2170) |
| Pro Gly Thr Xaa' Cys Gly Glu Ile Cys Xaa' Xaa' Ala Tyr Ala Ala Cys Thr Gly Cys Xaa' | (SEQ ID NO: 2171) |
| Pro Gly Thr Xaa' Cys Gly Glu Ile Cys Xaa' Ala Xaa' Tyr Xaa' Ala Ala Cys Thr Gly Cys | (SEQ ID NO: 2172) |
| Pro Gly Thr Xaa' Cys Gly Glu Ile Cys Xaa' Ala Xaa' Tyr Ala Xaa' Ala Cys Thr Gly Cys | (SEQ ID NO: 2173) |
| Pro Gly Thr Xaa' Cys Gly Glu Ile Cys Xaa' Ala Xaa' Tyr Ala Ala Xaa' Cys Thr Gly Cys | (SEQ ID NO: 2174) |
| Pro Gly Thr Xaa' Cys Gly Glu Ile Cys Xaa' Ala Xaa' Tyr Ala Ala Cys Xaa' Thr Gly Cys | (SEQ ID NO: 2175) |
| Pro Gly Thr Xaa' Cys Gly Glu Ile Cys Xaa' Ala Xaa' Tyr Ala Ala Cys Thr Gly Xaa' Cys | (SEQ ID NO: 2176) |
| Pro Gly Thr Xaa' Cys Gly Glu Ile Cys Xaa' Ala Xaa' Tyr Ala Ala Cys Thr Gly Cys Xaa' | (SEQ ID NO: 2177) |
| Pro Gly Thr Xaa' Cys Gly Glu Ile Cys Xaa' Ala Tyr Xaa' Ala Xaa' Ala Cys Thr Gly Cys | (SEQ ID NO: 2178) |
| Pro Gly Thr Xaa' Cys Gly Glu Ile Cys Xaa' Ala Tyr Xaa' Ala Ala Xaa' Cys Thr Gly Cys | (SEQ ID NO: 2179) |
| Pro Gly Thr Xaa' Cys Gly Glu Ile Cys Xaa' Ala Tyr Xaa' Ala Ala Cys Xaa' Thr Gly Cys | (SEQ ID NO: 2180) |

FIG. 2

| | | | | | | | | | | |
|---|---|---|---|---|---|---|---|---|---|---|
| Pro Gly Thr Xaa' Cys Gly Glu Ile Cys Xaa' Ala Xaa' Tyr Ala Ala Xaa' Cys Thr Gly Cys | (SEQID NO: 2181) |
| Pro Gly Thr Xaa' Cys Gly Glu Ile Cys Xaa' Ala Xaa' Tyr Ala Ala Xaa' Cys Xaa' Gly Cys | (SEQID NO: 2182) |
| Pro Gly Thr Xaa' Cys Gly Glu Ile Cys Xaa' Ala Xaa' Tyr Ala Ala Cys Thr Xaa' Gly Cys | (SEQID NO: 2183) |
| Pro Gly Thr Xaa' Cys Gly Glu Ile Cys Xaa' Ala Xaa' Tyr Ala Ala Cys Thr Gly Xaa' Cys | (SEQID NO: 2184) |
| Pro Gly Thr Xaa' Cys Gly Glu Ile Cys Xaa' Ala Xaa' Tyr Ala Ala Cys Thr Gly Cys Xaa' | (SEQID NO: 2185) |
| Pro Gly Thr Xaa' Cys Gly Glu Ile Cys Xaa' Ala Tyr Xaa' Ala Ala Ala Cys Thr Gly Cys | (SEQID NO: 2186) |
| Pro Gly Thr Xaa' Cys Gly Glu Ile Cys Xaa' Ala Tyr Xaa' Ala Ala Cys Xaa' Thr Gly Cys | (SEQID NO: 2187) |
| Pro Gly Thr Xaa' Cys Gly Glu Ile Cys Xaa' Ala Tyr Xaa' Ala Ala Cys Thr Xaa' Gly Cys | (SEQID NO: 2188) |
| Pro Gly Thr Xaa' Cys Gly Glu Ile Cys Xaa' Ala Tyr Xaa' Ala Ala Cys Thr Gly Xaa' Cys | (SEQID NO: 2189) |
| Pro Gly Thr Xaa' Cys Gly Glu Ile Cys Xaa' Ala Tyr Xaa' Ala Ala Cys Thr Gly Cys Xaa' | (SEQID NO: 2190) |
| Pro Gly Thr Xaa' Cys Gly Glu Ile Cys Xaa' Ala Tyr Ala Xaa' Ala Cys Thr Gly Cys | (SEQID NO: 2191) |
| Pro Gly Thr Xaa' Cys Gly Glu Ile Cys Xaa' Ala Tyr Ala Xaa' Ala Cys Xaa' Thr Gly Cys | (SEQID NO: 2192) |
| Pro Gly Thr Xaa' Cys Gly Glu Ile Cys Xaa' Ala Tyr Ala Xaa' Ala Cys Thr Xaa' Gly Cys | (SEQID NO: 2193) |
| Pro Gly Thr Xaa' Cys Gly Glu Ile Cys Xaa' Ala Tyr Ala Xaa' Ala Cys Thr Gly Cys Xaa' | (SEQID NO: 2194) |
| Pro Gly Thr Xaa' Cys Gly Glu Ile Cys Xaa' Ala Tyr Ala Ala Xaa' Cys Ala Cys Thr Gly Cys | (SEQID NO: 2195) |
| Pro Gly Thr Xaa' Cys Gly Glu Ile Cys Xaa' Ala Tyr Ala Ala Xaa' Cys Xaa' Thr Gly Cys | (SEQID NO: 2196) |
| Pro Gly Thr Xaa' Cys Gly Glu Ile Cys Xaa' Ala Tyr Ala Ala Xaa' Cys Thr Xaa' Gly Cys | (SEQID NO: 2197) |
| Pro Gly Thr Xaa' Cys Gly Glu Ile Cys Xaa' Ala Tyr Ala Ala Xaa' Cys Thr Gly Xaa' Cys | (SEQID NO: 2198) |
| Pro Gly Thr Xaa' Cys Gly Glu Ile Cys Xaa' Ala Tyr Ala Ala Xaa' Cys Thr Gly Cys Xaa' | (SEQID NO: 2199) |
| Pro Gly Thr Xaa' Cys Gly Glu Ile Cys Xaa' Ala Tyr Ala Ala Ala Xaa' Cys Thr Gly Cys | (SEQID NO: 2200) |
| Pro Gly Thr Xaa' Cys Gly Glu Ile Cys Xaa' Ala Tyr Ala Ala Ala Xaa' Cys Xaa' Thr Gly Cys | (SEQID NO: 2201) |
| Pro Gly Thr Xaa' Cys Gly Glu Ile Cys Xaa' Ala Tyr Ala Ala Ala Xaa' Cys Thr Xaa' Gly Cys | (SEQID NO: 2202) |
| Pro Gly Thr Xaa' Cys Gly Glu Ile Cys Xaa' Ala Tyr Ala Ala Ala Xaa' Cys Thr Gly Xaa' Cys | (SEQID NO: 2203) |
| Pro Gly Thr Xaa' Cys Gly Glu Ile Cys Xaa' Ala Tyr Ala Ala Ala Xaa' Cys Thr Gly Cys Xaa' | (SEQID NO: 2204) |
| Pro Gly Thr Xaa' Cys Gly Glu Ile Cys Xaa' Ala Tyr Ala Ala Ala Cys Xaa' Thr Gly Cys | (SEQID NO: 2205) |
| Pro Gly Thr Xaa' Cys Gly Glu Ile Cys Xaa' Ala Tyr Ala Ala Ala Cys Xaa' Thr Gly Cys Xaa' | (SEQID NO: 2206) |
| Pro Gly Thr Xaa' Cys Gly Glu Ile Cys Xaa' Ala Tyr Ala Ala Ala Cys Xaa' Gly Xaa' Cys | (SEQID NO: 2207) |
| Pro Gly Thr Xaa' Cys Gly Glu Ile Cys Xaa' Ala Tyr Ala Ala Ala Cys Xaa' Gly Cys Xaa' | (SEQID NO: 2208) |
| Pro Gly Thr Xaa' Cys Gly Glu Ile Cys Xaa' Ala Tyr Ala Ala Ala Cys Thr Xaa' Gly Cys | (SEQID NO: 2209) |
| Pro Gly Thr Xaa' Cys Gly Glu Ile Cys Xaa' Ala Tyr Ala Ala Ala Cys Thr Xaa' Gly Cys Xaa' | (SEQID NO: 2210) |
| Pro Gly Thr Xaa' Cys Gly Glu Ile Cys Xaa' Ala Tyr Ala Ala Ala Cys Thr Gly Xaa' Cys Xaa' | (SEQID NO: 2211) |
| Pro Gly Thr Xaa' Cys Gly Glu Ile Cys Xaa' Ala Tyr Ala Ala Ala Cys Thr Xaa' Xaa' Gly Cys | (SEQID NO: 2212) |
| Pro Gly Thr Xaa' Cys Gly Glu Ile Cys Xaa' Ala Tyr Ala Ala Ala Cys Thr Ala Xaa' Gly Cys | (SEQID NO: 2213) |
| Pro Gly Thr Xaa' Cys Gly Glu Ile Cys Xaa' Ala Tyr Ala Ala Ala Cys Thr Ala Xaa' Gly Cys | (SEQID NO: 2214) |

FIG. 2

| | |
|---|---|
| Pro Gly Thr Xaa' Cys Gly Glu Ile Cys Xaa' Ala Tyr Ala Ala Cys Thr Xaa' Gly Cys Xaa' | (SEQ ID NO: 2215) |
| Pro Gly Thr Xaa' Cys Gly Glu Ile Cys Xaa' Ala Tyr Ala Ala Cys Thr Gly Xaa' Cys | (SEQ ID NO: 2216) |
| Pro Gly Thr Xaa' Cys Gly Glu Ile Cys Xaa' Ala Tyr Ala Ala Cys Thr Gly Xaa' Xaa' Cys | (SEQ ID NO: 2217) |
| Pro Gly Thr Xaa' Cys Gly Glu Ile Cys Xaa' Ala Tyr Ala Ala Cys Thr Gly Xaa' Cys Xaa' | (SEQ ID NO: 2218) |
| Pro Gly Thr Xaa' Cys Gly Glu Ile Cys Xaa' Ala Tyr Ala Ala Cys Thr Gly Cys Xaa' | (SEQ ID NO: 2219) |
| Pro Gly Thr Xaa' Cys Gly Glu Ile Cys Ala Xaa' Tyr Ala Ala Cys Thr Gly Cys Xaa' Xaa' | (SEQ ID NO: 2220) |
| Pro Gly Thr Xaa' Cys Gly Glu Ile Cys Ala Xaa' Tyr Ala Ala Cys Thr Gly Cys | (SEQ ID NO: 2221) |
| Pro Gly Thr Xaa' Cys Gly Glu Ile Cys Ala Xaa' Xaa' Tyr Ala Ala Cys Thr Gly Cys | (SEQ ID NO: 2222) |
| Pro Gly Thr Xaa' Cys Gly Glu Ile Cys Ala Xaa' Xaa' Tyr Ala Ala Cys Thr Gly Cys | (SEQ ID NO: 2223) |
| Pro Gly Thr Xaa' Cys Gly Glu Ile Cys Ala Xaa' Xaa' Tyr Xaa' Ala Ala Cys Thr Gly Cys | (SEQ ID NO: 2224) |
| Pro Gly Thr Xaa' Cys Gly Glu Ile Cys Ala Xaa' Xaa' Tyr Xaa' Ala Xaa' Ala Cys Thr Gly Cys | (SEQ ID NO: 2225) |
| Pro Gly Thr Xaa' Cys Gly Glu Ile Cys Ala Xaa' Xaa' Tyr Xaa' Ala Xaa' Ala Cys Thr Gly Cys | (SEQ ID NO: 2226) |
| Pro Gly Thr Xaa' Cys Gly Glu Ile Cys Ala Xaa' Xaa' Tyr Xaa' Ala Ala Xaa' Cys Thr Gly Cys | (SEQ ID NO: 2227) |
| Pro Gly Thr Xaa' Cys Gly Glu Ile Cys Ala Xaa' Xaa' Tyr Xaa' Ala Ala Xaa' Cys Thr Gly Cys | (SEQ ID NO: 2228) |
| Pro Gly Thr Xaa' Cys Gly Glu Ile Cys Ala Xaa' Xaa' Tyr Xaa' Ala Ala Cys Thr Xaa' Gly Cys | (SEQ ID NO: 2229) |
| Pro Gly Thr Xaa' Cys Gly Glu Ile Cys Ala Xaa' Xaa' Tyr Xaa' Ala Ala Cys Thr Gly Xaa' Cys Xaa' | (SEQ ID NO: 2230) |
| Pro Gly Thr Xaa' Cys Gly Glu Ile Cys Ala Xaa' Xaa' Tyr Xaa' Ala Ala Cys Thr Gly Cys | (SEQ ID NO: 2231) |
| Pro Gly Thr Xaa' Cys Gly Glu Ile Cys Ala Xaa' Xaa' Tyr Xaa' Xaa' Ala Ala Cys Thr Gly Cys | (SEQ ID NO: 2232) |
| Pro Gly Thr Xaa' Cys Gly Glu Ile Cys Ala Xaa' Xaa' Tyr Xaa' Ala Xaa' Ala Cys Thr Gly Cys | (SEQ ID NO: 2233) |
| Pro Gly Thr Xaa' Cys Gly Glu Ile Cys Ala Xaa' Xaa' Tyr Xaa' Ala Xaa' Ala Cys Thr Gly Cys | (SEQ ID NO: 2234) |
| Pro Gly Thr Xaa' Cys Gly Glu Ile Cys Ala Xaa' Xaa' Tyr Xaa' Ala Ala Xaa' Cys Thr Gly Cys Xaa' | (SEQ ID NO: 2235) |
| Pro Gly Thr Xaa' Cys Gly Glu Ile Cys Ala Xaa' Xaa' Tyr Xaa' Ala Ala Cys Xaa' Thr Gly Cys | (SEQ ID NO: 2236) |
| Pro Gly Thr Xaa' Cys Gly Glu Ile Cys Ala Xaa' Xaa' Tyr Xaa' Ala Ala Cys Thr Xaa' Gly Cys | (SEQ ID NO: 2237) |
| Pro Gly Thr Xaa' Cys Gly Glu Ile Cys Ala Xaa' Xaa' Tyr Xaa' Ala Ala Cys Thr Gly Xaa' Cys Xaa' | (SEQ ID NO: 2238) |
| Pro Gly Thr Xaa' Cys Gly Glu Ile Cys Ala Xaa' Xaa' Tyr Ala Ala Cys Thr Gly Cys | (SEQ ID NO: 2239) |
| Pro Gly Thr Xaa' Cys Gly Glu Ile Cys Ala Xaa' Xaa' Tyr Ala Xaa' Ala Ala Cys Thr Gly Cys | (SEQ ID NO: 2240) |
| Pro Gly Thr Xaa' Cys Gly Glu Ile Cys Ala Xaa' Xaa' Tyr Ala Xaa' Ala Cys Thr Gly Cys | (SEQ ID NO: 2241) |
| Pro Gly Thr Xaa' Cys Gly Glu Ile Cys Ala Xaa' Xaa' Tyr Ala Ala Xaa' Cys Thr Gly Cys | (SEQ ID NO: 2242) |
| Pro Gly Thr Xaa' Cys Gly Glu Ile Cys Ala Xaa' Xaa' Tyr Ala Ala Xaa' Cys Thr Gly Cys | (SEQ ID NO: 2243) |
| Pro Gly Thr Xaa' Cys Gly Glu Ile Cys Ala Xaa' Xaa' Tyr Ala Ala Ala Cys Thr Gly Xaa' Cys | (SEQ ID NO: 2244) |
| Pro Gly Thr Xaa' Cys Gly Glu Ile Cys Ala Xaa' Xaa' Tyr Ala Ala Cys Thr Gly Xaa' Cys | (SEQ ID NO: 2245) |
| Pro Gly Thr Xaa' Cys Gly Glu Ile Cys Ala Xaa' Xaa' Tyr Ala Ala Cys Thr Gly Xaa' Cys Xaa' | (SEQ ID NO: 2246) |
| Pro Gly Thr Xaa' Cys Gly Glu Ile Cys Ala Xaa' Xaa' Tyr Ala Ala Cys Xaa' Thr Gly Cys | (SEQ ID NO: 2247) |
| Pro Gly Thr Xaa' Cys Gly Glu Ile Cys Ala Xaa' Xaa' Tyr Ala Ala Xaa' Cys Xaa' Thr Gly Cys | (SEQ ID NO: 2248) |

FIG. 2

| | | | | | | | | | | | | |
|---|---|---|---|---|---|---|---|---|---|---|---|---|
| Pro Gly Thr Xaa' Cys Gly Glu Ile Cys Ala Xaa' Tyr Ala Ala Xaa' Cys Thr Xaa' Gly Cys | (SEQ ID NO: 2249) |
| Pro Gly Thr Xaa' Cys Gly Glu Ile Cys Ala Xaa' Tyr Ala Ala Xaa' Cys Thr Gly Xaa' Cys | (SEQ ID NO: 2250) |
| Pro Gly Thr Xaa' Cys Gly Glu Ile Cys Ala Xaa' Tyr Ala Ala Xaa' Cys Thr Gly Cys Xaa' | (SEQ ID NO: 2251) |
| Pro Gly Thr Xaa' Cys Gly Glu Ile Cys Ala Xaa' Tyr Ala Ala Cys Xaa' Thr Gly Cys | (SEQ ID NO: 2252) |
| Pro Gly Thr Xaa' Cys Gly Glu Ile Cys Ala Xaa' Tyr Ala Ala Cys Xaa' Thr Xaa' Gly Cys | (SEQ ID NO: 2253) |
| Pro Gly Thr Xaa' Cys Gly Glu Ile Cys Ala Xaa' Tyr Ala Ala Cys Xaa' Thr Gly Xaa' Cys | (SEQ ID NO: 2254) |
| Pro Gly Thr Xaa' Cys Gly Glu Ile Cys Ala Xaa' Tyr Ala Ala Cys Xaa' Thr Gly Cys Xaa' | (SEQ ID NO: 2255) |
| Pro Gly Thr Xaa' Cys Gly Glu Ile Cys Ala Xaa' Tyr Ala Ala Cys Thr Xaa' Gly Cys | (SEQ ID NO: 2256) |
| Pro Gly Thr Xaa' Cys Gly Glu Ile Cys Ala Xaa' Tyr Ala Ala Cys Thr Gly Cys | (SEQ ID NO: 2257) |
| Pro Gly Thr Xaa' Cys Gly Glu Ile Cys Ala Xaa' Tyr Ala Ala Cys Thr Xaa' Gly Cys | (SEQ ID NO: 2258) |
| Pro Gly Thr Xaa' Cys Gly Glu Ile Cys Ala Xaa' Tyr Ala Ala Cys Thr Xaa' Gly Xaa' Cys | (SEQ ID NO: 2259) |
| Pro Gly Thr Xaa' Cys Gly Glu Ile Cys Ala Xaa' Tyr Ala Ala Cys Thr Xaa' Gly Cys Xaa' | (SEQ ID NO: 2260) |
| Pro Gly Thr Xaa' Cys Gly Glu Ile Cys Ala Xaa' Tyr Ala Ala Cys Thr Gly Xaa' Cys | (SEQ ID NO: 2261) |
| Pro Gly Thr Xaa' Cys Gly Glu Ile Cys Ala Xaa' Tyr Ala Ala Cys Thr Gly Xaa' Cys | (SEQ ID NO: 2262) |
| Pro Gly Thr Xaa' Cys Gly Glu Ile Cys Ala Xaa' Tyr Ala Ala Cys Thr Gly Xaa' Cys Xaa' | (SEQ ID NO: 2263) |
| Pro Gly Thr Xaa' Cys Gly Glu Ile Cys Ala Xaa' Tyr Ala Ala Cys Thr Gly Cys Xaa' | (SEQ ID NO: 2264) |
| Pro Gly Thr Xaa' Cys Gly Glu Ile Cys Ala Xaa' Tyr Ala Ala Cys Thr Gly Cys Xaa' | (SEQ ID NO: 2265) |
| Pro Gly Thr Xaa' Cys Gly Glu Ile Cys Ala Tyr Xaa' Ala Ala Cys Thr Gly Cys | (SEQ ID NO: 2266) |
| Pro Gly Thr Xaa' Cys Gly Glu Ile Cys Ala Tyr Xaa' Ala Ala Cys Thr Gly Cys | (SEQ ID NO: 2267) |
| Pro Gly Thr Xaa' Cys Gly Glu Ile Cys Ala Tyr Xaa' Xaa' Ala Ala Cys Thr Gly Cys | (SEQ ID NO: 2268) |
| Pro Gly Thr Xaa' Cys Gly Glu Ile Cys Ala Tyr Xaa' Xaa' Ala Ala Xaa' Cys Thr Gly Cys | (SEQ ID NO: 2269) |
| Pro Gly Thr Xaa' Cys Gly Glu Ile Cys Ala Tyr Xaa' Xaa' Ala Ala Xaa' Cys Thr Xaa' Gly Cys | (SEQ ID NO: 2270) |
| Pro Gly Thr Xaa' Cys Gly Glu Ile Cys Ala Tyr Xaa' Xaa' Ala Ala Xaa' Cys Thr Gly Xaa' Cys | (SEQ ID NO: 2271) |
| Pro Gly Thr Xaa' Cys Gly Glu Ile Cys Ala Tyr Xaa' Xaa' Ala Ala Xaa' Cys Thr Gly Cys Xaa' | (SEQ ID NO: 2272) |
| Pro Gly Thr Xaa' Cys Gly Glu Ile Cys Ala Tyr Xaa' Xaa' Ala Ala Cys Xaa' Thr Gly Cys | (SEQ ID NO: 2273) |
| Pro Gly Thr Xaa' Cys Gly Glu Ile Cys Ala Tyr Xaa' Xaa' Ala Ala Cys Xaa' Thr Gly Cys Xaa' | (SEQ ID NO: 2274) |
| Pro Gly Thr Xaa' Cys Gly Glu Ile Cys Ala Tyr Xaa' Ala Ala Cys Thr Gly Cys | (SEQ ID NO: 2275) |
| Pro Gly Thr Xaa' Cys Gly Glu Ile Cys Ala Tyr Xaa' Xaa' Ala Ala Cys Thr Xaa' Gly Cys | (SEQ ID NO: 2276) |
| Pro Gly Thr Xaa' Cys Gly Glu Ile Cys Ala Tyr Xaa' Xaa' Ala Ala Cys Thr Xaa' Gly Cys | (SEQ ID NO: 2277) |
| Pro Gly Thr Xaa' Cys Gly Glu Ile Cys Ala Tyr Xaa' Xaa' Ala Ala Cys Thr Xaa' Gly Cys Xaa' | (SEQ ID NO: 2278) |
| Pro Gly Thr Xaa' Cys Gly Glu Ile Cys Ala Tyr Xaa' Xaa' Ala Ala Cys Thr Gly Xaa' Cys | (SEQ ID NO: 2279) |
| Pro Gly Thr Xaa' Cys Gly Glu Ile Cys Ala Tyr Xaa' Xaa' Ala Ala Cys Thr Gly Xaa' Cys Xaa' | (SEQ ID NO: 2280) |
| Pro Gly Thr Xaa' Cys Gly Glu Ile Cys Ala Tyr Xaa' Ala Xaa' Ala Cys Thr Gly Cys | (SEQ ID NO: 2281) |
| Pro Gly Thr Xaa' Cys Gly Glu Ile Cys Ala Tyr Xaa' Ala Xaa' Ala Cys Thr Gly Cys | (SEQ ID NO: 2282) |

FIG. 2

| | | |
|---|---|---|
| Pro Gly Thr Xaa' Cys Gly Glu Ile Cys Ala Tyr Xaa' Ala Ala Xaa' Xaa' Cys Thr Gly Cys | (SEQ ID NO: 2283) |
| Pro Gly Thr Xaa' Cys Gly Glu Ile Cys Ala Tyr Xaa' Ala Ala Xaa' Xaa' Cys Xaa' Gly Cys | (SEQ ID NO: 2284) |
| Pro Gly Thr Xaa' Cys Gly Glu Ile Cys Ala Tyr Xaa' Ala Ala Xaa' Xaa' Cys Thr Xaa' Cys | (SEQ ID NO: 2285) |
| Pro Gly Thr Xaa' Cys Gly Glu Ile Cys Ala Tyr Xaa' Ala Ala Xaa' Xaa' Cys Thr Gly Xaa' | (SEQ ID NO: 2286) |
| Pro Gly Thr Xaa' Cys Gly Glu Ile Cys Ala Tyr Xaa' Ala Ala Xaa' Cys Xaa' Thr Gly Cys | (SEQ ID NO: 2287) |
| Pro Gly Thr Xaa' Cys Gly Glu Ile Cys Ala Tyr Xaa' Ala Ala Xaa' Cys Xaa' Xaa' Gly Cys | (SEQ ID NO: 2288) |
| Pro Gly Thr Xaa' Cys Gly Glu Ile Cys Ala Tyr Xaa' Ala Ala Xaa' Cys Xaa' Thr Xaa' Cys | (SEQ ID NO: 2289) |
| Pro Gly Thr Xaa' Cys Gly Glu Ile Cys Ala Tyr Xaa' Ala Ala Xaa' Cys Xaa' Thr Gly Xaa' | (SEQ ID NO: 2290) |
| Pro Gly Thr Xaa' Cys Gly Glu Ile Cys Ala Tyr Xaa' Ala Ala Cys Xaa' Xaa' Thr Gly Cys | (SEQ ID NO: 2291) |
| Pro Gly Thr Xaa' Cys Gly Glu Ile Cys Ala Tyr Xaa' Ala Ala Cys Xaa' Xaa' Xaa' Gly Cys | (SEQ ID NO: 2292) |
| Pro Gly Thr Xaa' Cys Gly Glu Ile Cys Ala Tyr Xaa' Ala Ala Cys Xaa' Xaa' Thr Xaa' Cys | (SEQ ID NO: 2293) |
| Pro Gly Thr Xaa' Cys Gly Glu Ile Cys Ala Tyr Xaa' Ala Ala Cys Xaa' Xaa' Thr Gly Xaa' | (SEQ ID NO: 2294) |
| Pro Gly Thr Xaa' Cys Gly Glu Ile Cys Ala Tyr Xaa' Ala Ala Cys Thr Xaa' Xaa' Gly Cys | (SEQ ID NO: 2295) |
| Pro Gly Thr Xaa' Cys Gly Glu Ile Cys Ala Tyr Xaa' Ala Ala Cys Thr Xaa' Thr Xaa' Cys | (SEQ ID NO: 2296) |
| Pro Gly Thr Xaa' Cys Gly Glu Ile Cys Ala Tyr Xaa' Ala Ala Cys Thr Xaa' Thr Gly Xaa' | (SEQ ID NO: 2297) |
| Pro Gly Thr Xaa' Cys Gly Glu Ile Cys Ala Tyr Xaa' Ala Ala Cys Thr Gly Xaa' Xaa' Cys | (SEQ ID NO: 2298) |
| Pro Gly Thr Xaa' Cys Gly Glu Ile Cys Ala Tyr Xaa' Ala Ala Cys Thr Gly Xaa' Cys Xaa' | (SEQ ID NO: 2299) |
| Pro Gly Thr Xaa' Cys Gly Glu Ile Cys Ala Tyr Xaa' Ala Ala Cys Thr Gly Cys Xaa' Xaa' | (SEQ ID NO: 2300) |
| Pro Gly Thr Xaa' Cys Gly Glu Ile Cys Ala Tyr Ala Xaa' Xaa' Xaa' Ala Cys Thr Gly Cys | (SEQ ID NO: 2301) |
| Pro Gly Thr Xaa' Cys Gly Glu Ile Cys Ala Tyr Ala Xaa' Xaa' Xaa' Ala Cys Thr Gly Cys | (SEQ ID NO: 2302) |
| Pro Gly Thr Xaa' Cys Gly Glu Ile Cys Ala Tyr Ala Xaa' Xaa' Xaa' Ala Cys Thr Gly Cys | (SEQ ID NO: 2303) |
| Pro Gly Thr Xaa' Cys Gly Glu Ile Cys Ala Tyr Ala Xaa' Xaa' Xaa' Ala Cys Thr Gly Cys | (SEQ ID NO: 2304) |
| Pro Gly Thr Xaa' Cys Gly Glu Ile Cys Ala Tyr Ala Xaa' Xaa' Ala Xaa' Cys Thr Gly Cys | (SEQ ID NO: 2305) |
| Pro Gly Thr Xaa' Cys Gly Glu Ile Cys Ala Tyr Ala Xaa' Xaa' Ala Xaa' Cys Thr Gly Cys | (SEQ ID NO: 2306) |
| Pro Gly Thr Xaa' Cys Gly Glu Ile Cys Ala Tyr Ala Xaa' Xaa' Ala Xaa' Cys Thr Gly Cys | (SEQ ID NO: 2307) |
| Pro Gly Thr Xaa' Cys Gly Glu Ile Cys Ala Tyr Ala Xaa' Xaa' Ala Xaa' Cys Thr Gly Cys | (SEQ ID NO: 2308) |
| Pro Gly Thr Xaa' Cys Gly Glu Ile Cys Ala Tyr Ala Xaa' Ala Xaa' Xaa' Cys Thr Gly Cys | (SEQ ID NO: 2309) |
| Pro Gly Thr Xaa' Cys Gly Glu Ile Cys Ala Tyr Ala Xaa' Ala Xaa' Xaa' Cys Thr Gly Cys | (SEQ ID NO: 2310) |
| Pro Gly Thr Xaa' Cys Gly Glu Ile Cys Ala Tyr Ala Xaa' Ala Xaa' Xaa' Cys Thr Gly Cys | (SEQ ID NO: 2311) |
| Pro Gly Thr Xaa' Cys Gly Glu Ile Cys Ala Tyr Ala Xaa' Ala Xaa' Xaa' Cys Thr Gly Cys | (SEQ ID NO: 2312) |
| Pro Gly Thr Xaa' Cys Gly Glu Ile Cys Ala Tyr Ala Ala Xaa' Xaa' Xaa' Cys Thr Gly Cys | (SEQ ID NO: 2313) |
| Pro Gly Thr Xaa' Cys Gly Glu Ile Cys Ala Tyr Ala Ala Xaa' Xaa' Xaa' Cys Xaa' Gly Cys | (SEQ ID NO: 2314) |
| Pro Gly Thr Xaa' Cys Gly Glu Ile Cys Ala Tyr Ala Ala Xaa' Xaa' Xaa' Cys Thr Xaa' Cys | (SEQ ID NO: 2315) |
| Pro Gly Thr Xaa' Cys Gly Glu Ile Cys Ala Tyr Ala Ala Xaa' Xaa' Xaa' Cys Thr Gly Cys | (SEQ ID NO: 2316) |

FIG. 2

| | | | | | | | | | | |
|---|---|---|---|---|---|---|---|---|---|---|
| Pro Gly Thr Xaa' Cys Gly Glu Ile Cys Ala Tyr Ala Xaa' Ala Cys Xaa' Xaa' Xaa' Thr Gly Cys | (SEQ ID NO: 2317) |
| Pro Gly Thr Xaa' Cys Gly Glu Ile Cys Ala Tyr Ala Xaa' Ala Cys Xaa' Xaa' Thr Xaa' Gly Cys | (SEQ ID NO: 2318) |
| Pro Gly Thr Xaa' Cys Gly Glu Ile Cys Ala Tyr Ala Xaa' Ala Cys Xaa' Xaa' Thr Gly Xaa' Cys | (SEQ ID NO: 2319) |
| Pro Gly Thr Xaa' Cys Gly Glu Ile Cys Ala Tyr Ala Xaa' Ala Cys Xaa' Xaa' Thr Gly Cys Xaa' | (SEQ ID NO: 2320) |
| Pro Gly Thr Xaa' Cys Gly Glu Ile Cys Ala Tyr Ala Xaa' Ala Cys Xaa' Thr Xaa' Xaa' Gly Cys | (SEQ ID NO: 2321) |
| Pro Gly Thr Xaa' Cys Gly Glu Ile Cys Ala Tyr Ala Xaa' Ala Cys Xaa' Thr Xaa' Gly Xaa' Cys | (SEQ ID NO: 2322) |
| Pro Gly Thr Xaa' Cys Gly Glu Ile Cys Ala Tyr Ala Xaa' Ala Cys Xaa' Thr Xaa' Gly Cys Xaa' | (SEQ ID NO: 2323) |
| Pro Gly Thr Xaa' Cys Gly Glu Ile Cys Ala Tyr Ala Xaa' Ala Cys Xaa' Thr Gly Xaa' Cys Xaa' | (SEQ ID NO: 2324) |
| Pro Gly Thr Xaa' Cys Gly Glu Ile Cys Ala Tyr Ala Xaa' Ala Cys Xaa' Thr Gly Xaa' Xaa' Cys | (SEQ ID NO: 2325) |
| Pro Gly Thr Xaa' Cys Gly Glu Ile Cys Ala Tyr Ala Xaa' Ala Cys Thr Xaa' Xaa' Xaa' Gly Cys | (SEQ ID NO: 2326) |
| Pro Gly Thr Xaa' Cys Gly Glu Ile Cys Ala Tyr Ala Xaa' Ala Cys Thr Xaa' Xaa' Gly Xaa' Cys | (SEQ ID NO: 2327) |
| Pro Gly Thr Xaa' Cys Gly Glu Ile Cys Ala Tyr Ala Xaa' Ala Cys Thr Xaa' Xaa' Gly Cys Xaa' | (SEQ ID NO: 2328) |
| Pro Gly Thr Xaa' Cys Gly Glu Ile Cys Ala Tyr Ala Xaa' Ala Cys Thr Xaa' Gly Xaa' Cys Xaa' | (SEQ ID NO: 2329) |
| Pro Gly Thr Xaa' Cys Gly Glu Ile Cys Ala Tyr Ala Xaa' Ala Ala Xaa' Xaa' Cys Thr Gly Cys | (SEQ ID NO: 2330) |
| Pro Gly Thr Xaa' Cys Gly Glu Ile Cys Ala Tyr Ala Xaa' Ala Ala Xaa' Cys Xaa' Thr Gly Cys | (SEQ ID NO: 2331) |
| Pro Gly Thr Xaa' Cys Gly Glu Ile Cys Ala Tyr Ala Xaa' Ala Ala Xaa' Xaa' Cys Thr Gly Cys | (SEQ ID NO: 2332) |
| Pro Gly Thr Xaa' Cys Gly Glu Ile Cys Ala Tyr Ala Xaa' Ala Ala Xaa' Cys Thr Xaa' Gly Cys | (SEQ ID NO: 2333) |
| Pro Gly Thr Xaa' Cys Gly Glu Ile Cys Ala Tyr Ala Xaa' Ala Ala Xaa' Cys Thr Xaa' Gly Cys | (SEQ ID NO: 2334) |
| Pro Gly Thr Xaa' Cys Gly Glu Ile Cys Ala Tyr Ala Xaa' Ala Ala Xaa' Cys Thr Gly Xaa' Cys | (SEQ ID NO: 2335) |
| Pro Gly Thr Xaa' Cys Gly Glu Ile Cys Ala Tyr Ala Xaa' Ala Ala Xaa' Cys Thr Gly Cys Xaa' | (SEQ ID NO: 2336) |
| Pro Gly Thr Xaa' Cys Gly Glu Ile Cys Ala Tyr Ala Xaa' Ala Ala Cys Xaa' Xaa' Thr Gly Cys | (SEQ ID NO: 2337) |
| Pro Gly Thr Xaa' Cys Gly Glu Ile Cys Ala Tyr Ala Xaa' Ala Ala Cys Xaa' Xaa' Thr Gly Cys | (SEQ ID NO: 2338) |
| Pro Gly Thr Xaa' Cys Gly Glu Ile Cys Ala Tyr Ala Xaa' Ala Ala Cys Xaa' Xaa' Thr Gly Cys | (SEQ ID NO: 2339) |
| Pro Gly Thr Xaa' Cys Gly Glu Ile Cys Ala Tyr Ala Xaa' Ala Ala Cys Xaa' Xaa' Thr Gly Cys | (SEQ ID NO: 2340) |
| Pro Gly Thr Xaa' Cys Gly Glu Ile Cys Ala Tyr Ala Xaa' Ala Ala Cys Xaa' Thr Xaa' Gly Cys | (SEQ ID NO: 2341) |
| Pro Gly Thr Xaa' Cys Gly Glu Ile Cys Ala Tyr Ala Xaa' Ala Ala Cys Xaa' Thr Xaa' Gly Cys | (SEQ ID NO: 2342) |
| Pro Gly Thr Xaa' Cys Gly Glu Ile Cys Ala Tyr Ala Xaa' Ala Ala Cys Xaa' Thr Xaa' Gly Cys | (SEQ ID NO: 2343) |
| Pro Gly Thr Xaa' Cys Gly Glu Ile Cys Ala Tyr Ala Xaa' Ala Ala Cys Xaa' Thr Gly Xaa' Cys | (SEQ ID NO: 2344) |
| Pro Gly Thr Xaa' Cys Gly Glu Ile Cys Ala Tyr Ala Xaa' Ala Ala Cys Xaa' Thr Gly Cys Xaa' | (SEQ ID NO: 2345) |
| Pro Gly Thr Xaa' Cys Gly Glu Ile Cys Ala Tyr Ala Xaa' Ala Ala Cys Thr Xaa' Xaa' Gly Cys | (SEQ ID NO: 2346) |
| Pro Gly Thr Xaa' Cys Gly Glu Ile Cys Ala Tyr Ala Xaa' Ala Ala Cys Thr Xaa' Xaa' Gly Cys | (SEQ ID NO: 2347) |
| Pro Gly Thr Xaa' Cys Gly Glu Ile Cys Ala Tyr Ala Xaa' Ala Ala Cys Thr Xaa' Gly Xaa' Cys | (SEQ ID NO: 2348) |
| Pro Gly Thr Xaa' Cys Gly Glu Ile Cys Ala Tyr Ala Xaa' Ala Ala Cys Thr Gly Cys Xaa' Xaa' | (SEQ ID NO: 2349) |
| Pro Gly Thr Xaa' Cys Gly Glu Ile Cys Ala Tyr Ala Ala Ala Cys Thr Gly Cys Xaa' Xaa' | (SEQ ID NO: 2350) |

FIG. 2

| | | | | | | | | | | | | | |
|---|---|---|---|---|---|---|---|---|---|---|---|---|---|
| Pro | Gly | Thr | Xaa' | Cys | Gly | Glu | Ile | Cys | Ala | Tyr | Ala | Ala | Cys | Xaa' | Thr | Gly | Cys | (SEQ ID NO: 2351) |
| Pro | Gly | Thr | Xaa' | Cys | Gly | Glu | Ile | Cys | Ala | Tyr | Ala | Ala | Cys | Xaa' | Xaa' | Thr | Gly | Cys | (SEQ ID NO: 2352) |
| Pro | Gly | Thr | Xaa' | Cys | Gly | Glu | Ile | Cys | Ala | Tyr | Ala | Ala | Cys | Xaa' | Xaa' | Xaa' | Thr | Gly | Cys | (SEQ ID NO: 2353) |
| Pro | Gly | Thr | Xaa' | Cys | Gly | Glu | Ile | Cys | Ala | Tyr | Ala | Ala | Cys | Xaa' | Xaa' | Xaa' | Xaa' | Thr | Gly | Cys | (SEQ ID NO: 2354) |
| Pro | Gly | Thr | Xaa' | Cys | Gly | Glu | Ile | Cys | Ala | Tyr | Ala | Ala | Cys | Xaa' | Xaa' | Xaa' | Xaa' | Thr | Gly | Xaa' | Cys | (SEQ ID NO: 2355) |
| Pro | Gly | Thr | Xaa' | Cys | Gly | Glu | Ile | Cys | Ala | Tyr | Ala | Ala | Cys | Xaa' | Xaa' | Xaa' | Thr | Gly | Xaa' | Cys | (SEQ ID NO: 2356) |
| Pro | Gly | Thr | Xaa' | Cys | Gly | Glu | Ile | Cys | Ala | Tyr | Ala | Ala | Cys | Xaa' | Xaa' | Thr | Gly | Xaa' | Cys | (SEQ ID NO: 2357) |
| Pro | Gly | Thr | Xaa' | Cys | Gly | Glu | Ile | Cys | Ala | Tyr | Ala | Ala | Cys | Xaa' | Thr | Xaa' | Xaa' | Gly | Cys | (SEQ ID NO: 2358) |
| Pro | Gly | Thr | Xaa' | Cys | Gly | Glu | Ile | Cys | Ala | Tyr | Ala | Ala | Cys | Xaa' | Thr | Xaa' | Gly | Xaa' | Cys | (SEQ ID NO: 2359) |
| Pro | Gly | Thr | Xaa' | Cys | Gly | Glu | Ile | Cys | Ala | Tyr | Ala | Ala | Cys | Xaa' | Thr | Gly | Xaa' | Cys | (SEQ ID NO: 2360) |
| Pro | Gly | Thr | Xaa' | Cys | Gly | Glu | Ile | Cys | Ala | Tyr | Ala | Ala | Cys | Xaa' | Thr | Gly | Xaa' | Xaa' | Cys | (SEQ ID NO: 2361) |
| Pro | Gly | Thr | Xaa' | Cys | Gly | Glu | Ile | Cys | Ala | Tyr | Ala | Ala | Cys | Xaa' | Thr | Gly | Xaa' | Xaa' | Cys | (SEQ ID NO: 2362) |
| Pro | Gly | Thr | Xaa' | Cys | Gly | Glu | Ile | Cys | Ala | Tyr | Ala | Ala | Cys | Xaa' | Thr | Gly | Xaa' | Cys | Xaa' | (SEQ ID NO: 2363) |
| Pro | Gly | Thr | Xaa' | Cys | Gly | Glu | Ile | Cys | Ala | Tyr | Ala | Ala | Cys | Xaa' | Thr | Gly | Cys | Xaa' | (SEQ ID NO: 2364) |
| Pro | Gly | Thr | Xaa' | Cys | Gly | Glu | Ile | Cys | Ala | Tyr | Ala | Ala | Cys | Xaa' | Thr | Gly | Cys | Xaa' | Xaa' | (SEQ ID NO: 2365) |
| Pro | Gly | Thr | Xaa' | Cys | Gly | Glu | Ile | Cys | Ala | Tyr | Ala | Ala | Cys | Thr | Gly | Cys | (SEQ ID NO: 2366) |
| Pro | Gly | Thr | Xaa' | Cys | Gly | Glu | Ile | Cys | Ala | Tyr | Ala | Ala | Cys | Thr | Xaa' | Xaa' | Gly | Cys | (SEQ ID NO: 2367) |
| Pro | Gly | Thr | Xaa' | Cys | Gly | Glu | Ile | Cys | Ala | Tyr | Ala | Ala | Cys | Thr | Xaa' | Xaa' | Xaa' | Gly | Cys | (SEQ ID NO: 2368) |
| Pro | Gly | Thr | Xaa' | Cys | Gly | Glu | Ile | Cys | Ala | Tyr | Ala | Ala | Cys | Thr | Xaa' | Xaa' | Gly | Xaa' | Cys | (SEQ ID NO: 2369) |
| Pro | Gly | Thr | Xaa' | Cys | Gly | Glu | Ile | Cys | Ala | Tyr | Ala | Ala | Cys | Thr | Xaa' | Gly | Xaa' | Cys | (SEQ ID NO: 2370) |
| Pro | Gly | Thr | Xaa' | Cys | Gly | Glu | Ile | Cys | Ala | Tyr | Ala | Ala | Cys | Thr | Xaa' | Gly | Xaa' | Xaa' | Cys | (SEQ ID NO: 2371) |
| Pro | Gly | Thr | Xaa' | Cys | Gly | Glu | Ile | Cys | Ala | Tyr | Ala | Ala | Cys | Thr | Xaa' | Gly | Xaa' | Cys | (SEQ ID NO: 2372) |
| Pro | Gly | Thr | Xaa' | Cys | Gly | Glu | Ile | Cys | Ala | Tyr | Ala | Ala | Cys | Thr | Gly | Xaa' | Xaa' | Xaa' | Cys | (SEQ ID NO: 2373) |
| Pro | Gly | Thr | Xaa' | Cys | Gly | Glu | Ile | Cys | Ala | Tyr | Ala | Ala | Cys | Thr | Gly | Xaa' | Xaa' | Cys | Xaa' | (SEQ ID NO: 2374) |
| Pro | Gly | Thr | Xaa' | Cys | Gly | Glu | Ile | Cys | Ala | Tyr | Ala | Ala | Cys | Thr | Gly | Xaa' | Cys | Xaa' | (SEQ ID NO: 2375) |
| Pro | Gly | Thr | Xaa' | Cys | Gly | Glu | Ile | Cys | Ala | Tyr | Ala | Ala | Cys | Thr | Gly | Xaa' | Cys | Xaa' | Xaa' | (SEQ ID NO: 2376) |
| Pro | Gly | Thr | Xaa' | Cys | Gly | Glu | Ile | Cys | Ala | Tyr | Ala | Ala | Cys | Thr | Gly | Cys | (SEQ ID NO: 2377) |
| Pro | Gly | Thr | Xaa' | Cys | Gly | Glu | Ile | Cys | Ala | Tyr | Ala | Ala | Cys | Thr | Gly | Cys | Xaa' | (SEQ ID NO: 2378) |
| Pro | Gly | Thr | Xaa' | Cys | Gly | Glu | Ile | Cys | Ala | Tyr | Ala | Ala | Cys | Thr | Gly | Cys | Xaa' | Xaa' | Xaa' | Cys | (SEQ ID NO: 2379) |
| Pro | Gly | Thr | Xaa' | Cys | Gly | Glu | Ile | Cys | Ala | Tyr | Ala | Ala | Cys | Thr | Gly | Cys | Xaa' | Xaa' | (SEQ ID NO: 2380) |
| Pro | Gly | Thr | Xaa' | Cys | Gly | Glu | Ile | Cys | Ala | Tyr | Ala | Ala | Cys | Thr | Gly | Cys | Xaa' | Xaa' | Xaa' | (SEQ ID NO: 2381) |
| Pro | Gly | Thr | Xaa' | Cys | Gly | Glu | Ile | Cys | Ala | Tyr | Ala | Ala | Cys | Thr | Gly | Cys | Xaa' | Xaa' | Xaa' | Xaa' | (SEQ ID NO: 2382) |
| Pro | Gly | Thr | Xaa' | Cys | Gly | Glu | Ile | Cys | Ala | Tyr | Ala | Ala | Cys | Thr | Gly | Cys | Xaa' | Xaa' | Xaa' | (SEQ ID NO: 2383) |
| Pro | Gly | Thr | Xaa' | Cys | Gly | Glu | Ile | Cys | Ala | Tyr | Ala | Ala | Cys | Thr | Gly | Cys | Xaa' | Xaa' | Xaa' | (SEQ ID NO: 2384) |

```
Pro Gly Thr Cys Xaa' Gly  Glu  Ile  Cys Ala Tyr Ala Ala  Cys Thr Gly Cys       (SEQ ID NO: 2385)
Pro Gly Thr Cys Xaa' Gly  Glu  Ile  Cys Ala Tyr Ala Ala  Cys Thr Gly Cys       (SEQ ID NO: 2386)
Pro Gly Thr Cys Xaa' Gly  Glu  Ile  Cys Ala Tyr Ala Ala  Cys Thr Gly Cys       (SEQ ID NO: 2387)
Pro Gly Thr Cys Xaa' Xaa' Xaa' Ile  Cys Ala Tyr Ala Ala  Cys Thr Gly Cys       (SEQ ID NO: 2388)
Pro Gly Thr Cys Xaa' Xaa' Glu  Ile  Cys Ala Tyr Ala Ala  Cys Thr Gly Cys       (SEQ ID NO: 2389)
Pro Gly Thr Cys Xaa' Xaa' Glu  Xaa' Cys Ala Tyr Ala Ala  Cys Thr Gly Cys       (SEQ ID NO: 2390)
Pro Gly Thr Cys Xaa' Xaa' Glu  Ile  Cys Ala Tyr Ala Ala  Cys Thr Gly Cys       (SEQ ID NO: 2391)
Pro Gly Thr Cys Xaa' Xaa' Glu  Ile  Cys Xaa' Tyr Ala Ala  Cys Thr Gly Cys      (SEQ ID NO: 2392)
Pro Gly Thr Cys Xaa' Xaa' Glu  Ile  Cys Ala Xaa' Ala Ala  Cys Thr Gly Cys      (SEQ ID NO: 2393)
Pro Gly Thr Cys Xaa' Xaa' Glu  Ile  Cys Ala Tyr Xaa' Ala  Cys Thr Gly Cys      (SEQ ID NO: 2394)
Pro Gly Thr Cys Xaa' Xaa' Glu  Ile  Cys Ala Tyr Ala Xaa'  Cys Thr Gly Cys      (SEQ ID NO: 2395)
Pro Gly Thr Cys Xaa' Xaa' Glu  Ile  Cys Ala Tyr Ala Ala  Cys Xaa' Gly Cys      (SEQ ID NO: 2396)
Pro Gly Thr Cys Xaa' Xaa' Glu  Ile  Cys Ala Tyr Ala Ala  Cys Thr Xaa' Cys      (SEQ ID NO: 2397)
Pro Gly Thr Cys Xaa' Xaa' Glu  Ile  Cys Ala Tyr Ala Xaa'  Cys Thr Gly Cys      (SEQ ID NO: 2398)
Pro Gly Thr Cys Xaa' Xaa' Glu  Ile  Cys Ala Tyr Ala Ala  Cys Thr Gly Xaa'      (SEQ ID NO: 2399)
Pro Gly Thr Cys Xaa' Gly  Xaa' Ile  Cys Ala Tyr Ala Ala  Cys Thr Gly Cys       (SEQ ID NO: 2400)
Pro Gly Thr Cys Xaa' Xaa' Xaa' Ile  Cys Ala Tyr Ala Ala  Cys Thr Gly Cys       (SEQ ID NO: 2401)
Pro Gly Thr Cys Xaa' Xaa' Glu  Xaa' Cys Ala Tyr Ala Ala  Cys Thr Gly Cys       (SEQ ID NO: 2402)
Pro Gly Thr Cys Xaa' Xaa' Glu  Ile  Cys Xaa' Tyr Ala Ala  Cys Thr Gly Cys      (SEQ ID NO: 2403)
Pro Gly Thr Cys Xaa' Xaa' Glu  Ile  Cys Ala Xaa' Ala Ala  Cys Thr Gly Cys      (SEQ ID NO: 2404)
Pro Gly Thr Cys Xaa' Xaa' Glu  Ile  Cys Ala Tyr Xaa' Ala  Cys Thr Gly Cys      (SEQ ID NO: 2405)
Pro Gly Thr Cys Xaa' Xaa' Glu  Ile  Cys Ala Tyr Ala Xaa'  Cys Thr Gly Cys      (SEQ ID NO: 2406)
Pro Gly Thr Cys Xaa' Xaa' Glu  Ile  Cys Ala Tyr Ala Ala  Cys Xaa' Gly Cys      (SEQ ID NO: 2407)
Pro Gly Thr Cys Xaa' Xaa' Glu  Ile  Cys Ala Tyr Ala Ala  Cys Thr Xaa' Cys      (SEQ ID NO: 2408)
Pro Gly Thr Cys Xaa' Xaa' Glu  Ile  Cys Ala Tyr Ala Ala  Cys Thr Gly Xaa'      (SEQ ID NO: 2409)
Pro Gly Thr Cys Xaa' Gly  Glu  Xaa' Cys Ala Tyr Ala Ala  Cys Thr Gly Cys       (SEQ ID NO: 2410)
Pro Gly Thr Cys Xaa' Gly  Glu  Ile  Cys Xaa' Tyr Ala Ala  Cys Thr Gly Cys      (SEQ ID NO: 2411)
Pro Gly Thr Cys Xaa' Gly  Glu  Ile  Cys Ala Xaa' Ala Ala  Cys Thr Gly Cys      (SEQ ID NO: 2412)
Pro Gly Thr Cys Xaa' Gly  Glu  Ile  Cys Ala Tyr Xaa' Ala  Cys Thr Gly Cys      (SEQ ID NO: 2413)
Pro Gly Thr Cys Xaa' Gly  Glu  Ile  Cys Ala Tyr Ala Xaa'  Cys Thr Gly Cys      (SEQ ID NO: 2414)
Pro Gly Thr Cys Xaa' Gly  Glu  Ile  Cys Ala Tyr Ala Ala  Cys Xaa' Gly Cys      (SEQ ID NO: 2415)
Pro Gly Thr Cys Xaa' Gly  Glu  Ile  Cys Ala Tyr Ala Ala  Cys Thr Xaa' Cys      (SEQ ID NO: 2416)
Pro Gly Thr Cys Xaa' Gly  Xaa' Ile  Cys Ala Tyr Ala Ala  Cys Thr Gly Cys       (SEQ ID NO: 2417)
Pro Gly Thr Cys Xaa' Glu  Xaa' Ile  Cys Ala Xaa' Tyr Ala Ala Cys Thr Gly Cys   (SEQ ID NO: 2418)
```

Pro Gly Thr Cys Xaa' Xaa' Gly Glu Xaa' Ile Cys Ala Tyr Xaa' Ala Ala Cys Thr Gly Cys (SEQ ID NO: 2419)
Pro Gly Thr Cys Xaa' Xaa' Gly Glu Xaa' Ile Cys Ala Tyr Ala Ala Xaa' Ala Cys Thr Gly Cys (SEQ ID NO: 2420)
Pro Gly Thr Cys Xaa' Xaa' Gly Glu Xaa' Ile Cys Ala Tyr Ala Ala Ala Xaa' Cys Thr Gly Cys (SEQ ID NO: 2421)
Pro Gly Thr Cys Xaa' Xaa' Gly Glu Xaa' Ile Cys Ala Tyr Ala Ala Ala Ala Cys Xaa' Gly Cys (SEQ ID NO: 2422)
Pro Gly Thr Cys Xaa' Xaa' Gly Glu Xaa' Ile Cys Ala Tyr Ala Ala Ala Ala Cys Thr Gly Xaa' (SEQ ID NO: 2423)
Pro Gly Thr Cys Xaa' Xaa' Gly Glu Xaa' Ile Cys Ala Tyr Ala Ala Ala Ala Cys Thr Gly Cys Xaa' (SEQ ID NO: 2424)
Pro Gly Thr Cys Xaa' Xaa' Gly Glu Xaa' Ile Cys Ala Tyr Ala Ala Ala Ala Cys Thr Gly Cys Xaa' (SEQ ID NO: 2425)
Pro Gly Thr Cys Xaa' Xaa' Gly Glu Xaa' Ile Xaa' Ala Tyr Ala Ala Ala Ala Cys Thr Gly Cys (SEQ ID NO: 2426)
Pro Gly Thr Cys Xaa' Xaa' Gly Glu Ile Ile Cys Ala Tyr Ala Ala Ala Ala Cys Thr Gly Cys (SEQ ID NO: 2427)
Pro Gly Thr Cys Xaa' Xaa' Gly Glu Xaa' Ile Cys Xaa' Tyr Ala Ala Ala Ala Cys Thr Gly Cys (SEQ ID NO: 2428)
Pro Gly Thr Cys Xaa' Xaa' Gly Glu Xaa' Ile Cys Ala Xaa' Ala Ala Ala Ala Cys Thr Gly Cys (SEQ ID NO: 2429)
Pro Gly Thr Cys Xaa' Xaa' Gly Glu Xaa' Ile Cys Ala Xaa' Tyr Ala Ala Ala Ala Cys Thr Gly Cys (SEQ ID NO: 2430)
Pro Gly Thr Cys Xaa' Xaa' Gly Glu Xaa' Ile Cys Ala Xaa' Tyr Xaa' Ala Ala Cys Thr Gly Cys (SEQ ID NO: 2431)
Pro Gly Thr Cys Xaa' Xaa' Gly Glu Xaa' Ile Cys Ala Xaa' Tyr Ala Xaa' Ala Cys Thr Gly Cys (SEQ ID NO: 2432)
Pro Gly Thr Cys Xaa' Xaa' Gly Glu Xaa' Ile Cys Ala Xaa' Tyr Ala Ala Xaa' Cys Thr Gly Cys (SEQ ID NO: 2433)
Pro Gly Thr Cys Xaa' Xaa' Gly Glu Xaa' Ile Cys Ala Xaa' Tyr Ala Ala Ala Cys Xaa' Gly Cys (SEQ ID NO: 2434)
Pro Gly Thr Cys Xaa' Xaa' Gly Glu Xaa' Ile Cys Ala Xaa' Tyr Ala Ala Ala Cys Thr Gly Xaa' (SEQ ID NO: 2435)
Pro Gly Thr Cys Xaa' Xaa' Gly Glu Xaa' Ile Cys Ala Xaa' Tyr Ala Ala Ala Cys Thr Gly Cys Xaa' (SEQ ID NO: 2436)
Pro Gly Thr Cys Xaa' Xaa' Gly Glu Xaa' Ile Cys Xaa' Ala Tyr Ala Ala Ala Cys Thr Gly Cys (SEQ ID NO: 2437)
Pro Gly Thr Cys Xaa' Xaa' Gly Glu Ile Ile Cys Xaa' Ala Tyr Ala Ala Ala Cys Thr Gly Cys (SEQ ID NO: 2438)
Pro Gly Thr Cys Xaa' Xaa' Gly Glu Xaa' Ile Cys Xaa' Ala Tyr Xaa' Ala Ala Cys Thr Gly Cys (SEQ ID NO: 2439)
Pro Gly Thr Cys Xaa' Xaa' Gly Glu Xaa' Ile Cys Xaa' Ala Tyr Ala Xaa' Ala Cys Thr Gly Cys (SEQ ID NO: 2440)
Pro Gly Thr Cys Xaa' Xaa' Gly Glu Xaa' Ile Cys Xaa' Ala Tyr Ala Ala Xaa' Cys Thr Gly Cys (SEQ ID NO: 2441)
Pro Gly Thr Cys Xaa' Xaa' Gly Glu Xaa' Ile Cys Xaa' Ala Tyr Ala Ala Ala Cys Xaa' Gly Cys (SEQ ID NO: 2442)
Pro Gly Thr Cys Xaa' Xaa' Gly Glu Xaa' Ile Cys Xaa' Ala Tyr Ala Ala Ala Cys Thr Gly Xaa' (SEQ ID NO: 2443)
Pro Gly Thr Cys Xaa' Xaa' Gly Glu Xaa' Ile Cys Xaa' Ala Tyr Ala Ala Ala Cys Thr Gly Cys Xaa' (SEQ ID NO: 2444)
Pro Gly Thr Cys Xaa' Xaa' Gly Glu Xaa' Ile Cys Ala Xaa' Xaa' Ala Ala Ala Cys Thr Gly Cys (SEQ ID NO: 2445)
Pro Gly Thr Cys Xaa' Xaa' Gly Glu Xaa' Ile Cys Ala Xaa' Tyr Ala Ala Ala Cys Thr Gly Cys (SEQ ID NO: 2446)
Pro Gly Thr Cys Xaa' Xaa' Gly Glu Xaa' Ile Cys Ala Xaa' Tyr Ala Ala Ala Cys Thr Gly Cys Xaa' (SEQ ID NO: 2447)
Pro Gly Thr Cys Xaa' Xaa' Gly Glu Xaa' Ile Cys Ala Xaa' Tyr Ala Ala Ala Cys Thr Gly Cys (SEQ ID NO: 2448)
Pro Gly Thr Cys Xaa' Xaa' Gly Glu Xaa' Ile Cys Ala Xaa' Tyr Ala Ala Ala Cys Thr Gly Cys (SEQ ID NO: 2449)
Pro Gly Thr Cys Xaa' Xaa' Gly Glu Ile Ile Cys Ala Xaa' Tyr Ala Ala Ala Cys Thr Gly Cys (SEQ ID NO: 2450)
Pro Gly Thr Cys Xaa' Xaa' Gly Glu Xaa' Ile Cys Ala Xaa' Tyr Ala Ala Ala Cys Thr Gly Cys (SEQ ID NO: 2451)
Pro Gly Thr Cys Xaa' Xaa' Gly Glu Xaa' Ile Cys Ala Xaa' Tyr Ala Ala Xaa' Cys Thr Gly Cys (SEQ ID NO: 2452)

FIG. 2

```
Pro Gly Thr Cys Xaa' Xaa' Gly Glu Ile Cys Ala Xaa' Tyr Ala Ala Cys Thr Xaa' Gly Cys    (SEQ ID NO: 2453)
Pro Gly Thr Cys Xaa' Xaa' Gly Glu Ile Cys Ala Xaa' Tyr Ala Ala Cys Thr Gly Xaa' Cys    (SEQ ID NO: 2454)
Pro Gly Thr Cys Xaa' Xaa' Gly Glu Ile Cys Ala Xaa' Tyr Ala Ala Cys Thr Gly Cys Xaa'    (SEQ ID NO: 2455)
Pro Gly Thr Cys Xaa' Xaa' Gly Glu Ile Cys Ala Xaa' Tyr Ala Ala Cys Thr Gly Cys         (SEQ ID NO: 2456)
Pro Gly Thr Cys Xaa' Xaa' Gly Glu Ile Cys Ala Xaa' Tyr Xaa' Ala Ala Cys Thr Gly Cys    (SEQ ID NO: 2457)
Pro Gly Thr Cys Xaa' Xaa' Gly Glu Ile Cys Ala Xaa' Tyr Xaa' Ala Xaa' Ala Cys Thr Gly Cys (SEQ ID NO: 2458)
Pro Gly Thr Cys Xaa' Xaa' Gly Glu Ile Cys Ala Xaa' Tyr Xaa' Ala Ala Xaa' Cys Thr Gly Cys (SEQ ID NO: 2459)
Pro Gly Thr Cys Xaa' Xaa' Gly Glu Ile Cys Ala Xaa' Tyr Xaa' Ala Ala Cys Xaa' Thr Gly Cys (SEQ ID NO: 2460)
Pro Gly Thr Cys Xaa' Xaa' Gly Glu Ile Cys Ala Xaa' Tyr Xaa' Ala Ala Cys Thr Xaa' Gly Cys (SEQ ID NO: 2461)
Pro Gly Thr Cys Xaa' Xaa' Gly Glu Ile Cys Ala Xaa' Tyr Xaa' Ala Ala Cys Thr Gly Xaa' Cys (SEQ ID NO: 2462)
Pro Gly Thr Cys Xaa' Xaa' Gly Glu Ile Cys Ala Xaa' Tyr Xaa' Ala Ala Cys Thr Gly Cys Xaa' (SEQ ID NO: 2463)
Pro Gly Thr Cys Xaa' Xaa' Gly Glu Ile Cys Ala Xaa' Tyr Xaa' Ala Ala Cys Thr Gly Cys    (SEQ ID NO: 2464)
Pro Gly Thr Cys Xaa' Xaa' Gly Glu Ile Cys Ala Xaa' Tyr Ala Xaa' Ala Cys Thr Gly Cys    (SEQ ID NO: 2465)
Pro Gly Thr Cys Xaa' Xaa' Gly Glu Ile Cys Ala Xaa' Tyr Ala Xaa' Ala Xaa' Cys Thr Gly Cys (SEQ ID NO: 2466)
Pro Gly Thr Cys Xaa' Xaa' Gly Glu Ile Cys Ala Xaa' Tyr Ala Xaa' Ala Cys Xaa' Thr Gly Cys (SEQ ID NO: 2467)
Pro Gly Thr Cys Xaa' Xaa' Gly Glu Ile Cys Ala Xaa' Tyr Ala Xaa' Ala Cys Thr Xaa' Gly Cys (SEQ ID NO: 2468)
Pro Gly Thr Cys Xaa' Xaa' Gly Glu Ile Cys Ala Xaa' Tyr Ala Xaa' Ala Cys Thr Gly Xaa' Cys (SEQ ID NO: 2469)
Pro Gly Thr Cys Xaa' Xaa' Gly Glu Ile Cys Ala Xaa' Tyr Ala Xaa' Ala Cys Thr Gly Cys Xaa' (SEQ ID NO: 2470)
Pro Gly Thr Cys Xaa' Xaa' Gly Glu Ile Cys Ala Xaa' Tyr Ala Xaa' Ala Cys Thr Gly Cys    (SEQ ID NO: 2471)
Pro Gly Thr Cys Xaa' Xaa' Gly Glu Ile Cys Ala Xaa' Tyr Ala Ala Xaa' Cys Thr Gly Cys    (SEQ ID NO: 2472)
Pro Gly Thr Cys Xaa' Xaa' Gly Glu Ile Cys Ala Xaa' Tyr Ala Ala Xaa' Cys Xaa' Thr Gly Cys (SEQ ID NO: 2473)
Pro Gly Thr Cys Xaa' Xaa' Gly Glu Ile Cys Ala Xaa' Tyr Ala Ala Xaa' Cys Thr Xaa' Gly Cys (SEQ ID NO: 2474)
Pro Gly Thr Cys Xaa' Xaa' Gly Glu Ile Cys Ala Xaa' Tyr Ala Ala Xaa' Cys Thr Gly Xaa' Cys (SEQ ID NO: 2475)
Pro Gly Thr Cys Xaa' Xaa' Gly Glu Ile Cys Ala Xaa' Tyr Ala Ala Xaa' Cys Thr Gly Cys Xaa' (SEQ ID NO: 2476)
Pro Gly Thr Cys Xaa' Xaa' Gly Glu Ile Cys Ala Xaa' Tyr Ala Ala Xaa' Cys Thr Gly Cys    (SEQ ID NO: 2477)
Pro Gly Thr Cys Xaa' Xaa' Gly Glu Ile Cys Ala Xaa' Tyr Ala Ala Cys Xaa' Thr Gly Cys    (SEQ ID NO: 2478)
Pro Gly Thr Cys Xaa' Xaa' Gly Glu Ile Cys Ala Xaa' Tyr Ala Ala Cys Xaa' Thr Xaa' Gly Cys (SEQ ID NO: 2479)
Pro Gly Thr Cys Xaa' Xaa' Gly Glu Ile Cys Ala Xaa' Tyr Ala Ala Cys Xaa' Thr Gly Xaa' Cys (SEQ ID NO: 2480)
Pro Gly Thr Cys Xaa' Xaa' Gly Glu Ile Cys Ala Xaa' Tyr Ala Ala Cys Xaa' Thr Gly Cys Xaa' (SEQ ID NO: 2481)
Pro Gly Thr Cys Xaa' Xaa' Gly Glu Ile Cys Ala Xaa' Tyr Ala Ala Cys Xaa' Thr Gly Cys    (SEQ ID NO: 2482)
Pro Gly Thr Cys Xaa' Xaa' Gly Glu Ile Cys Ala Xaa' Tyr Ala Ala Cys Thr Xaa' Gly Cys    (SEQ ID NO: 2483)
Pro Gly Thr Cys Xaa' Xaa' Gly Glu Ile Cys Ala Xaa' Tyr Ala Ala Cys Thr Xaa' Gly Xaa' Cys (SEQ ID NO: 2484)
Pro Gly Thr Cys Xaa' Xaa' Gly Glu Ile Cys Ala Xaa' Tyr Ala Ala Cys Thr Xaa' Gly Cys Xaa' (SEQ ID NO: 2485)
Pro Gly Thr Cys Xaa' Xaa' Gly Glu Ile Cys Ala Tyr Ala Ala Cys Thr Gly Xaa' Cys         (SEQ ID NO: 2486)
```

Pro Gly Thr Cys Xaa' Gly Xaa' Glu Ile Xaa' Cys Ala Tyr Xaa' Ala Ala Cys Thr Gly Cys (SEQID NO: 2521 )
Pro Gly Thr Cys Xaa' Gly Xaa' Glu Ile Xaa' Cys Ala Tyr Ala Xaa' Ala Cys Thr Gly Cys (SEQID NO: 2522 )
Pro Gly Thr Cys Xaa' Gly Xaa' Glu Ile Xaa' Cys Ala Tyr Ala Ala Xaa' Cys Thr Gly Cys (SEQID NO: 2523 )
Pro Gly Thr Cys Xaa' Gly Xaa' Glu Ile Xaa' Cys Ala Tyr Ala Ala Cys Xaa' Thr Gly Cys (SEQID NO: 2524 )
Pro Gly Thr Cys Xaa' Gly Xaa' Glu Ile Xaa' Cys Ala Tyr Ala Ala Cys Thr Xaa' Gly Cys (SEQID NO: 2525 )
Pro Gly Thr Cys Xaa' Gly Xaa' Glu Ile Xaa' Cys Ala Tyr Ala Ala Cys Thr Gly Xaa' Cys (SEQID NO: 2526 )
Pro Gly Thr Cys Xaa' Gly Xaa' Glu Ile Xaa' Cys Ala Tyr Ala Ala Cys Thr Gly Cys Xaa' (SEQID NO: 2527 )
Pro Gly Thr Cys Xaa' Gly Xaa' Glu Ile Cys Xaa' Ala Tyr Ala Ala Cys Thr Gly Cys (SEQID NO: 2528 )
Pro Gly Thr Cys Xaa' Gly Xaa' Glu Ile Cys Xaa' Xaa' Ala Tyr Ala Ala Cys Thr Gly Cys (SEQID NO: 2529 )
Pro Gly Thr Cys Xaa' Gly Xaa' Glu Ile Cys Xaa' Ala Xaa' Tyr Ala Ala Cys Thr Gly Cys (SEQID NO: 2530 )
Pro Gly Thr Cys Xaa' Gly Xaa' Glu Ile Cys Xaa' Ala Tyr Xaa' Ala Ala Cys Thr Gly Cys (SEQID NO: 2531 )
Pro Gly Thr Cys Xaa' Gly Xaa' Glu Ile Cys Xaa' Ala Tyr Ala Xaa' Ala Cys Thr Gly Cys (SEQID NO: 2532 )
Pro Gly Thr Cys Xaa' Gly Xaa' Glu Ile Cys Xaa' Ala Tyr Ala Ala Xaa' Cys Thr Gly Cys (SEQID NO: 2533 )
Pro Gly Thr Cys Xaa' Gly Xaa' Glu Ile Cys Xaa' Ala Tyr Ala Ala Cys Xaa' Thr Gly Cys (SEQID NO: 2534 )
Pro Gly Thr Cys Xaa' Gly Xaa' Glu Ile Cys Xaa' Ala Tyr Ala Ala Cys Thr Xaa' Gly Cys (SEQID NO: 2535 )
Pro Gly Thr Cys Xaa' Gly Xaa' Glu Ile Cys Xaa' Ala Tyr Ala Ala Cys Thr Gly Xaa' Cys (SEQID NO: 2536 )
Pro Gly Thr Cys Xaa' Gly Xaa' Glu Ile Cys Xaa' Ala Tyr Ala Ala Cys Thr Gly Cys Xaa' (SEQID NO: 2537 )
Pro Gly Thr Cys Xaa' Gly Xaa' Glu Ile Cys Ala Xaa' Tyr Ala Ala Cys Thr Gly Cys (SEQID NO: 2538 )
Pro Gly Thr Cys Xaa' Gly Xaa' Glu Ile Cys Ala Xaa' Xaa' Tyr Ala Ala Cys Thr Gly Cys (SEQID NO: 2539 )
Pro Gly Thr Cys Xaa' Gly Xaa' Glu Ile Cys Ala Xaa' Tyr Xaa' Ala Ala Cys Thr Gly Cys (SEQID NO: 2540 )
Pro Gly Thr Cys Xaa' Gly Xaa' Glu Ile Cys Ala Xaa' Tyr Ala Xaa' Ala Cys Thr Gly Cys (SEQID NO: 2541 )
Pro Gly Thr Cys Xaa' Gly Xaa' Glu Ile Cys Ala Xaa' Tyr Ala Ala Xaa' Cys Thr Gly Cys (SEQID NO: 2542 )
Pro Gly Thr Cys Xaa' Gly Xaa' Glu Ile Cys Ala Xaa' Tyr Ala Ala Cys Xaa' Thr Gly Cys (SEQID NO: 2543 )
Pro Gly Thr Cys Xaa' Gly Xaa' Glu Ile Cys Ala Xaa' Tyr Ala Ala Cys Thr Xaa' Gly Cys (SEQID NO: 2544 )
Pro Gly Thr Cys Xaa' Gly Xaa' Glu Ile Cys Ala Xaa' Tyr Ala Ala Cys Thr Gly Xaa' Cys (SEQID NO: 2545 )
Pro Gly Thr Cys Xaa' Gly Xaa' Glu Ile Cys Ala Xaa' Tyr Ala Ala Cys Thr Gly Cys Xaa' (SEQID NO: 2546 )
Pro Gly Thr Cys Xaa' Gly Xaa' Glu Ile Cys Ala Tyr Xaa' Ala Ala Cys Thr Gly Cys (SEQID NO: 2547 )
Pro Gly Thr Cys Xaa' Gly Xaa' Glu Ile Cys Ala Tyr Xaa' Xaa' Ala Ala Cys Thr Gly Cys (SEQID NO: 2548 )
Pro Gly Thr Cys Xaa' Gly Xaa' Glu Ile Cys Ala Tyr Xaa' Ala Xaa' Ala Cys Thr Gly Cys (SEQID NO: 2549 )
Pro Gly Thr Cys Xaa' Gly Xaa' Glu Ile Cys Ala Tyr Xaa' Ala Ala Xaa' Cys Thr Gly Cys (SEQID NO: 2550 )
Pro Gly Thr Cys Xaa' Gly Xaa' Glu Ile Cys Ala Tyr Xaa' Ala Ala Cys Xaa' Thr Gly Cys (SEQID NO: 2551 )
Pro Gly Thr Cys Xaa' Gly Xaa' Glu Ile Cys Ala Tyr Xaa' Ala Ala Cys Thr Xaa' Gly Cys (SEQID NO: 2552 )
Pro Gly Thr Cys Xaa' Gly Xaa' Glu Ile Cys Ala Tyr Xaa' Ala Ala Cys Thr Gly Xaa' Cys (SEQID NO: 2553 )
Pro Gly Thr Cys Xaa' Gly Xaa' Glu Ile Cys Ala Tyr Xaa' Ala Ala Cys Thr Gly Cys Xaa' (SEQID NO: 2554 )

FIG. 2

| | | | | | | | | | | | | |
|---|---|---|---|---|---|---|---|---|---|---|---|---|
| Pro | Gly | Thr | Cys | Xaa' | Gly | Xaa' | Glu | Ile | Cys | Ala | Tyr | Ala | Xaa' | Ala | Cys | Thr | Gly | Cys | (SEQ ID NO: 2555) |
| Pro | Gly | Thr | Cys | Xaa' | Gly | Xaa' | Glu | Ile | Cys | Ala | Tyr | Ala | Xaa' | Ala | Cys | Thr | Gly | Cys | (SEQ ID NO: 2556) |
| Pro | Gly | Thr | Cys | Xaa' | Gly | Xaa' | Glu | Ile | Cys | Ala | Tyr | Ala | Xaa' | Ala | Cys | Thr | Gly | Cys | (SEQ ID NO: 2557) |
| Pro | Gly | Thr | Cys | Xaa' | Gly | Xaa' | Glu | Ile | Cys | Ala | Tyr | Ala | Xaa' | Ala | Cys | Thr | Gly | Cys | (SEQ ID NO: 2558) |
| Pro | Gly | Thr | Cys | Xaa' | Gly | Xaa' | Glu | Ile | Cys | Ala | Tyr | Ala | Xaa' | Ala | Cys | Thr | Gly | Cys | (SEQ ID NO: 2559) |
| Pro | Gly | Thr | Cys | Xaa' | Gly | Xaa' | Glu | Ile | Cys | Ala | Tyr | Ala | Xaa' | Ala | Cys | Thr | Gly | Cys | (SEQ ID NO: 2560) |
| Pro | Gly | Thr | Cys | Xaa' | Gly | Xaa' | Glu | Ile | Cys | Ala | Tyr | Ala | Xaa' | Ala | Cys | Thr | Gly | Cys | (SEQ ID NO: 2561) |
| Pro | Gly | Thr | Cys | Xaa' | Gly | Xaa' | Glu | Ile | Cys | Ala | Tyr | Ala | Xaa' | Ala | Cys | Thr | Gly | Cys | (SEQ ID NO: 2562) |
| Pro | Gly | Thr | Cys | Xaa' | Gly | Xaa' | Glu | Ile | Cys | Ala | Tyr | Ala | Ala | Xaa' | Cys | Thr | Gly | Cys | (SEQ ID NO: 2563) |
| Pro | Gly | Thr | Cys | Xaa' | Gly | Xaa' | Glu | Ile | Cys | Ala | Tyr | Ala | Ala | Xaa' | Cys | Thr | Gly | Cys | (SEQ ID NO: 2564) |
| Pro | Gly | Thr | Cys | Xaa' | Gly | Xaa' | Glu | Ile | Cys | Ala | Tyr | Ala | Ala | Xaa' | Cys | Thr | Gly | Cys | (SEQ ID NO: 2565) |
| Pro | Gly | Thr | Cys | Xaa' | Gly | Xaa' | Glu | Ile | Cys | Ala | Tyr | Ala | Ala | Xaa' | Cys | Thr | Gly | Cys | (SEQ ID NO: 2566) |
| Pro | Gly | Thr | Cys | Xaa' | Gly | Xaa' | Glu | Ile | Cys | Ala | Tyr | Ala | Ala | Xaa' | Cys | Thr | Gly | Cys | (SEQ ID NO: 2567) |
| Pro | Gly | Thr | Cys | Xaa' | Gly | Xaa' | Glu | Ile | Cys | Ala | Tyr | Ala | Ala | Xaa' | Cys | Thr | Gly | Cys | (SEQ ID NO: 2568) |
| Pro | Gly | Thr | Cys | Xaa' | Gly | Xaa' | Glu | Ile | Cys | Ala | Tyr | Ala | Ala | Xaa' | Cys | Thr | Gly | Cys | (SEQ ID NO: 2569) |
| Pro | Gly | Thr | Cys | Xaa' | Gly | Xaa' | Glu | Ile | Cys | Ala | Tyr | Ala | Ala | Xaa' | Cys | Thr | Gly | Cys | (SEQ ID NO: 2570) |
| Pro | Gly | Thr | Cys | Xaa' | Gly | Xaa' | Glu | Ile | Cys | Ala | Tyr | Ala | Ala | Cys | Thr | Gly | Xaa' | Cys | (SEQ ID NO: 2571) |
| Pro | Gly | Thr | Cys | Xaa' | Gly | Xaa' | Glu | Ile | Cys | Ala | Tyr | Ala | Ala | Cys | Thr | Gly | Xaa' | Cys | (SEQ ID NO: 2572) |
| Pro | Gly | Thr | Cys | Xaa' | Gly | Xaa' | Glu | Ile | Cys | Ala | Tyr | Ala | Ala | Cys | Thr | Gly | Xaa' | Cys | (SEQ ID NO: 2573) |
| Pro | Gly | Thr | Cys | Xaa' | Gly | Xaa' | Glu | Ile | Cys | Ala | Tyr | Ala | Ala | Cys | Thr | Xaa' | Gly | Cys | (SEQ ID NO: 2574) |
| Pro | Gly | Thr | Cys | Xaa' | Gly | Xaa' | Glu | Ile | Cys | Ala | Tyr | Ala | Ala | Cys | Thr | Xaa' | Gly | Cys | (SEQ ID NO: 2575) |
| Pro | Gly | Thr | Cys | Xaa' | Gly | Xaa' | Glu | Ile | Cys | Ala | Tyr | Ala | Ala | Cys | Thr | Xaa' | Gly | Cys | (SEQ ID NO: 2576) |
| Pro | Gly | Thr | Cys | Xaa' | Gly | Xaa' | Glu | Ile | Cys | Ala | Tyr | Ala | Ala | Cys | Thr | Gly | Xaa' | Cys | (SEQ ID NO: 2577) |
| Pro | Gly | Thr | Cys | Xaa' | Gly | Xaa' | Glu | Ile | Cys | Ala | Tyr | Ala | Ala | Cys | Thr | Gly | Xaa' | Cys | (SEQ ID NO: 2578) |
| Pro | Gly | Thr | Cys | Xaa' | Gly | Xaa' | Glu | Ile | Cys | Ala | Tyr | Ala | Ala | Cys | Thr | Gly | Xaa' | Cys | (SEQ ID NO: 2579) |
| Pro | Gly | Thr | Cys | Xaa' | Gly | Xaa' | Glu | Ile | Cys | Ala | Tyr | Ala | Ala | Cys | Thr | Gly | Cys | (SEQ ID NO: 2580) |
| Pro | Gly | Thr | Cys | Xaa' | Gly | Glu | Xaa' | Ile | Cys | Ala | Tyr | Ala | Ala | Cys | Thr | Gly | Cys | (SEQ ID NO: 2581) |
| Pro | Gly | Thr | Cys | Xaa' | Gly | Glu | Xaa' | Ile | Cys | Ala | Tyr | Ala | Ala | Cys | Thr | Gly | Cys | (SEQ ID NO: 2582) |
| Pro | Gly | Thr | Cys | Xaa' | Gly | Glu | Xaa' | Xaa' | Cys | Ala | Tyr | Ala | Ala | Cys | Thr | Gly | Cys | (SEQ ID NO: 2583) |
| Pro | Gly | Thr | Cys | Xaa' | Gly | Glu | Xaa' | Ile | Cys | Xaa' | Tyr | Ala | Ala | Cys | Thr | Gly | Cys | (SEQ ID NO: 2584) |
| Pro | Gly | Thr | Cys | Xaa' | Gly | Glu | Xaa' | Ile | Cys | Xaa' | Tyr | Ala | Ala | Cys | Thr | Gly | Cys | (SEQ ID NO: 2585) |
| Pro | Gly | Thr | Cys | Xaa' | Gly | Glu | Xaa' | Ile | Cys | Xaa' | Tyr | Ala | Ala | Cys | Thr | Gly | Cys | (SEQ ID NO: 2586) |
| Pro | Gly | Thr | Cys | Xaa' | Gly | Glu | Xaa' | Ile | Cys | Ala | Xaa' | Ala | Ala | Cys | Thr | Gly | Cys | (SEQ ID NO: 2587) |
| Pro | Gly | Thr | Cys | Xaa' | Gly | Glu | Xaa' | Ile | Cys | Ala | Tyr | Ala' | Ala | Cys | Thr | Gly | Cys | (SEQ ID NO: 2588) |

FIG. 2

| | | | | | | | | | | | | |
|---|---|---|---|---|---|---|---|---|---|---|---|---|
| Pro | Gly | Thr | Cys | Xaa' | Gly | Glu | Xaa' | Xaa' | Ile | Cys | Ala | Tyr | Ala | Xaa' | Ala | Cys | Thr | Gly | Cys | (SEQ ID NO: 2589) |
| Pro | Gly | Thr | Cys | Xaa' | Gly | Glu | Xaa' | Xaa' | Ile | Cys | Ala | Tyr | Ala | Ala | Xaa' | Cys | Thr | Gly | Cys | (SEQ ID NO: 2590) |
| Pro | Gly | Thr | Cys | Xaa' | Gly | Glu | Xaa' | Xaa' | Ile | Cys | Ala | Tyr | Ala | Ala | Ala | Cys | Xaa' | Gly | Cys | (SEQ ID NO: 2591) |
| Pro | Gly | Thr | Cys | Xaa' | Gly | Glu | Xaa' | Xaa' | Ile | Cys | Ala | Tyr | Ala | Ala | Ala | Cys | Thr | Gly | Cys | (SEQ ID NO: 2592) |
| Pro | Gly | Thr | Cys | Xaa' | Gly | Glu | Xaa' | Xaa' | Ile | Cys | Ala | Tyr | Ala | Ala | Ala | Cys | Thr | Gly | Xaa' | (SEQ ID NO: 2593) |
| Pro | Gly | Thr | Cys | Xaa' | Gly | Glu | Xaa' | Xaa' | Ile | Cys | Ala | Tyr | Ala | Ala | Ala | Cys | Thr | Gly | Cys | (SEQ ID NO: 2594) |
| Pro | Gly | Thr | Cys | Xaa' | Gly | Glu | Xaa' | Xaa' | Ile | Xaa' | Ala | Cys | Ala | Tyr | Ala | Ala | Cys | Thr | Gly | Cys | (SEQ ID NO: 2595) |
| Pro | Gly | Thr | Cys | Xaa' | Gly | Glu | Xaa' | Xaa' | Ile | Xaa' | Ala | Cys | Xaa' | Tyr | Ala | Ala | Ala | Cys | Thr | Gly | Cys | (SEQ ID NO: 2596) |
| Pro | Gly | Thr | Cys | Xaa' | Gly | Glu | Xaa' | Xaa' | Ile | Xaa' | Ala | Cys | Ala | Tyr | Ala | Ala | Ala | Cys | Thr | Gly | Cys | (SEQ ID NO: 2597) |
| Pro | Gly | Thr | Cys | Xaa' | Gly | Glu | Xaa' | Xaa' | Ile | Xaa' | Ala | Cys | Xaa' | Tyr | Ala | Ala | Ala | Cys | Thr | Gly | Cys | (SEQ ID NO: 2598) |
| Pro | Gly | Thr | Cys | Xaa' | Gly | Glu | Xaa' | Xaa' | Ile | Xaa' | Ala | Cys | Ala | Tyr | Xaa' | Ala | Ala | Cys | Thr | Gly | Cys | (SEQ ID NO: 2599) |
| Pro | Gly | Thr | Cys | Xaa' | Gly | Glu | Xaa' | Xaa' | Ile | Xaa' | Ala | Cys | Ala | Tyr | Ala | Xaa' | Ala | Cys | Thr | Gly | Cys | (SEQ ID NO: 2600) |
| Pro | Gly | Thr | Cys | Xaa' | Gly | Glu | Xaa' | Xaa' | Ile | Xaa' | Ala | Cys | Ala | Tyr | Ala | Ala | Xaa' | Cys | Thr | Gly | Cys | (SEQ ID NO: 2601) |
| Pro | Gly | Thr | Cys | Xaa' | Gly | Glu | Xaa' | Xaa' | Ile | Xaa' | Ala | Cys | Ala | Tyr | Ala | Ala | Ala | Cys | Xaa' | Gly | Cys | (SEQ ID NO: 2602) |
| Pro | Gly | Thr | Cys | Xaa' | Gly | Glu | Xaa' | Xaa' | Ile | Xaa' | Ala | Cys | Ala | Tyr | Ala | Ala | Ala | Cys | Thr | Xaa' | Cys | (SEQ ID NO: 2603) |
| Pro | Gly | Thr | Cys | Xaa' | Gly | Glu | Xaa' | Xaa' | Ile | Xaa' | Ala | Cys | Ala | Tyr | Ala | Ala | Ala | Cys | Thr | Gly | Xaa' | (SEQ ID NO: 2604) |
| Pro | Gly | Thr | Cys | Xaa' | Gly | Glu | Xaa' | Xaa' | Ile | Cys | Xaa' | Ala | Tyr | Ala | Ala | Ala | Cys | Thr | Gly | Cys | (SEQ ID NO: 2605) |
| Pro | Gly | Thr | Cys | Xaa' | Gly | Glu | Xaa' | Xaa' | Ile | Cys | Xaa' | Ala | Tyr | Ala | Ala | Ala | Cys | Thr | Gly | Cys | (SEQ ID NO: 2606) |
| Pro | Gly | Thr | Cys | Xaa' | Gly | Glu | Xaa' | Xaa' | Ile | Cys | Xaa' | Ala | Tyr | Ala | Ala | Ala | Cys | Thr | Gly | Cys | (SEQ ID NO: 2607) |
| Pro | Gly | Thr | Cys | Xaa' | Gly | Glu | Xaa' | Xaa' | Ile | Cys | Xaa' | Ala | Tyr | Ala | Ala | Ala | Cys | Thr | Gly | Cys | (SEQ ID NO: 2608) |
| Pro | Gly | Thr | Cys | Xaa' | Gly | Glu | Xaa' | Xaa' | Ile | Cys | Xaa' | Ala | Tyr | Ala | Ala | Ala | Cys | Thr | Gly | Cys | (SEQ ID NO: 2609) |
| Pro | Gly | Thr | Cys | Xaa' | Gly | Glu | Xaa' | Xaa' | Ile | Cys | Xaa' | Ala | Tyr | Ala | Ala | Ala | Cys | Thr | Gly | Cys | (SEQ ID NO: 2610) |
| Pro | Gly | Thr | Cys | Xaa' | Gly | Glu | Xaa' | Xaa' | Ile | Cys | Xaa' | Ala | Tyr | Ala | Ala | Ala | Cys | Thr | Gly | Cys | (SEQ ID NO: 2611) |
| Pro | Gly | Thr | Cys | Xaa' | Gly | Glu | Xaa' | Xaa' | Ile | Cys | Xaa' | Ala | Tyr | Ala | Ala | Ala | Cys | Thr | Gly | Cys | (SEQ ID NO: 2612) |
| Pro | Gly | Thr | Cys | Xaa' | Gly | Glu | Xaa' | Xaa' | Ile | Cys | Xaa' | Ala | Tyr | Ala | Ala | Ala | Cys | Thr | Gly | Cys | (SEQ ID NO: 2613) |
| Pro | Gly | Thr | Cys | Xaa' | Gly | Glu | Xaa' | Xaa' | Ile | Cys | Ala | Xaa' | Tyr | Ala | Ala | Xaa' | Cys | Thr | Gly | Cys | (SEQ ID NO: 2614) |
| Pro | Gly | Thr | Cys | Xaa' | Gly | Glu | Xaa' | Xaa' | Ile | Cys | Ala | Xaa' | Tyr | Ala | Ala | Ala | Cys | Thr | Gly | Xaa' | (SEQ ID NO: 2615) |
| Pro | Gly | Thr | Cys | Xaa' | Gly | Glu | Xaa' | Xaa' | Ile | Cys | Ala | Xaa' | Tyr | Ala | Ala | Ala | Cys | Thr | Gly | Cys | (SEQ ID NO: 2616) |
| Pro | Gly | Thr | Cys | Xaa' | Gly | Glu | Xaa' | Xaa' | Ile | Cys | Ala | Xaa' | Tyr | Ala | Ala | Ala | Cys | Thr | Gly | Cys | (SEQ ID NO: 2617) |
| Pro | Gly | Thr | Cys | Xaa' | Gly | Glu | Xaa' | Xaa' | Ile | Cys | Ala | Xaa' | Tyr | Ala | Ala | Ala | Cys | Thr | Gly | Cys | (SEQ ID NO: 2618) |
| Pro | Gly | Thr | Cys | Xaa' | Gly | Glu | Xaa' | Xaa' | Ile | Cys | Ala | Xaa' | Tyr | Ala | Ala | Ala | Cys | Thr | Gly | Cys | (SEQ ID NO: 2619) |
| Pro | Gly | Thr | Cys | Xaa' | Gly | Glu | Xaa' | Xaa' | Ile | Cys | Ala | Xaa' | Tyr | Ala | Ala | Ala | Cys | Thr | Gly | Cys | (SEQ ID NO: 2620) |
| Pro | Gly | Thr | Cys | Xaa' | Gly | Glu | Xaa' | Xaa' | Ile | Cys | Ala | Xaa' | Tyr | Ala | Ala | Ala | Cys | Thr | Gly | Cys | (SEQ ID NO: 2621) |
| Pro | Gly | Thr | Cys | Xaa' | Gly | Glu | Xaa' | Xaa' | Ile | Cys | Ala | Xaa' | Tyr | Ala | Ala | Ala | Cys | Thr | Gly | Cys | (SEQ ID NO: 2622) |

FIG. 2

| | | | | | | | | | | | | |
|---|---|---|---|---|---|---|---|---|---|---|---|---|
| Pro | Gly | Thr | Cys | Xaa' | Gly | Glu | Xaa' | Ile | Cys | Ala | Xaa' | Tyr | Ala | Ala | Cys | Thr | Gly | Xaa' | Cys | (SEQ ID NO: 2623) |
| Pro | Gly | Thr | Cys | Xaa' | Gly | Glu | Xaa' | Ile | Cys | Ala | Xaa' | Tyr | Ala | Ala | Cys | Thr | Gly | Cys | Xaa' | (SEQ ID NO: 2624) |
| Pro | Gly | Thr | Cys | Xaa' | Gly | Glu | Xaa' | Ile | Cys | Ala | Tyr | Xaa' | Ala | Ala | Cys | Thr | Gly | Cys | | (SEQ ID NO: 2625) |
| Pro | Gly | Thr | Cys | Xaa' | Gly | Glu | Xaa' | Ile | Cys | Ala | Tyr | Xaa' | Ala | Ala | Cys | Thr | Gly | Gly | Cys | (SEQ ID NO: 2626) |
| Pro | Gly | Thr | Cys | Xaa' | Gly | Glu | Xaa' | Ile | Cys | Ala | Tyr | Xaa' | Ala | Ala | Cys | Ala | Thr | Gly | Cys | (SEQ ID NO: 2627) |
| Pro | Gly | Thr | Cys | Xaa' | Gly | Glu | Xaa' | Ile | Cys | Ala | Tyr | Xaa' | Ala | Xaa' | Ala | Cys | Thr | Gly | Cys | (SEQ ID NO: 2628) |
| Pro | Gly | Thr | Cys | Xaa' | Gly | Glu | Xaa' | Ile | Cys | Ala | Tyr | Xaa' | Ala | Xaa' | Ala | Cys | Thr | Gly | Cys | (SEQ ID NO: 2629) |
| Pro | Gly | Thr | Cys | Xaa' | Gly | Glu | Xaa' | Ile | Cys | Ala | Tyr | Xaa' | Ala | Ala | Xaa' | Cys | Thr | Gly | Cys | (SEQ ID NO: 2630) |
| Pro | Gly | Thr | Cys | Xaa' | Gly | Glu | Xaa' | Ile | Cys | Ala | Tyr | Xaa' | Ala | Ala | Cys | Thr | Xaa' | Gly | Cys | (SEQ ID NO: 2631) |
| Pro | Gly | Thr | Cys | Xaa' | Gly | Glu | Xaa' | Ile | Cys | Ala | Tyr | Xaa' | Ala | Ala | Cys | Thr | Gly | Xaa' | Cys | (SEQ ID NO: 2632) |
| Pro | Gly | Thr | Cys | Xaa' | Gly | Glu | Xaa' | Ile | Cys | Ala | Tyr | Xaa' | Ala | Ala | Cys | Thr | Gly | Cys | Xaa' | (SEQ ID NO: 2633) |
| Pro | Gly | Thr | Cys | Xaa' | Gly | Glu | Xaa' | Ile | Cys | Ala | Tyr | Ala | Xaa' | Xaa' | Ala | Cys | Thr | Gly | Cys | (SEQ ID NO: 2634) |
| Pro | Gly | Thr | Cys | Xaa' | Gly | Glu | Xaa' | Ile | Cys | Ala | Tyr | Ala | Xaa' | Ala | Xaa' | Cys | Thr | Gly | Cys | (SEQ ID NO: 2635) |
| Pro | Gly | Thr | Cys | Xaa' | Gly | Glu | Xaa' | Ile | Cys | Ala | Tyr | Ala | Xaa' | Ala | Cys | Xaa' | Thr | Gly | Cys | (SEQ ID NO: 2636) |
| Pro | Gly | Thr | Cys | Xaa' | Gly | Glu | Xaa' | Ile | Cys | Ala | Tyr | Ala | Xaa' | Ala | Cys | Thr | Xaa' | Gly | Cys | (SEQ ID NO: 2637) |
| Pro | Gly | Thr | Cys | Xaa' | Gly | Glu | Xaa' | Ile | Cys | Ala | Tyr | Ala | Xaa' | Ala | Cys | Thr | Gly | Xaa' | Cys | (SEQ ID NO: 2638) |
| Pro | Gly | Thr | Cys | Xaa' | Gly | Glu | Xaa' | Ile | Cys | Ala | Tyr | Ala | Xaa' | Ala | Cys | Thr | Gly | Cys | Xaa' | (SEQ ID NO: 2639) |
| Pro | Gly | Thr | Cys | Xaa' | Gly | Glu | Xaa' | Ile | Cys | Ala | Tyr | Ala | Ala | Xaa' | Xaa' | Cys | Thr | Gly | Cys | (SEQ ID NO: 2640) |
| Pro | Gly | Thr | Cys | Xaa' | Gly | Glu | Xaa' | Ile | Cys | Ala | Tyr | Ala | Ala | Xaa' | Cys | Xaa' | Thr | Gly | Cys | (SEQ ID NO: 2641) |
| Pro | Gly | Thr | Cys | Xaa' | Gly | Glu | Xaa' | Ile | Cys | Ala | Tyr | Ala | Ala | Xaa' | Cys | Thr | Xaa' | Gly | Cys | (SEQ ID NO: 2642) |
| Pro | Gly | Thr | Cys | Xaa' | Gly | Glu | Xaa' | Ile | Cys | Ala | Tyr | Ala | Ala | Xaa' | Cys | Thr | Gly | Xaa' | Cys | (SEQ ID NO: 2643) |
| Pro | Gly | Thr | Cys | Xaa' | Gly | Glu | Xaa' | Ile | Cys | Ala | Tyr | Ala | Ala | Xaa' | Cys | Thr | Gly | Cys | Xaa' | (SEQ ID NO: 2644) |
| Pro | Gly | Thr | Cys | Xaa' | Gly | Glu | Xaa' | Ile | Cys | Ala | Tyr | Ala | Ala | Cys | Xaa' | Xaa' | Thr | Gly | Cys | (SEQ ID NO: 2645) |
| Pro | Gly | Thr | Cys | Xaa' | Gly | Glu | Xaa' | Ile | Cys | Ala | Tyr | Ala | Ala | Cys | Xaa' | Thr | Xaa' | Gly | Cys | (SEQ ID NO: 2646) |
| Pro | Gly | Thr | Cys | Xaa' | Gly | Glu | Xaa' | Ile | Cys | Ala | Tyr | Ala | Ala | Cys | Xaa' | Thr | Gly | Xaa' | Cys | (SEQ ID NO: 2647) |
| Pro | Gly | Thr | Cys | Xaa' | Gly | Glu | Xaa' | Ile | Cys | Ala | Tyr | Ala | Ala | Cys | Xaa' | Thr | Gly | Cys | Xaa' | (SEQ ID NO: 2648) |
| Pro | Gly | Thr | Cys | Xaa' | Gly | Glu | Xaa' | Ile | Cys | Ala | Tyr | Ala | Ala | Cys | Thr | Xaa' | Xaa' | Gly | Cys | (SEQ ID NO: 2649) |
| Pro | Gly | Thr | Cys | Xaa' | Gly | Glu | Xaa' | Ile | Cys | Ala | Tyr | Ala | Ala | Cys | Thr | Xaa' | Gly | Xaa' | Cys | (SEQ ID NO: 2650) |
| Pro | Gly | Thr | Cys | Xaa' | Gly | Glu | Xaa' | Ile | Cys | Ala | Tyr | Ala | Ala | Cys | Thr | Xaa' | Gly | Cys | | (SEQ ID NO: 2651) |
| Pro | Gly | Thr | Cys | Xaa' | Gly | Glu | Xaa' | Ile | Cys | Ala | Tyr | Ala | Ala | Cys | Thr | Xaa' | Xaa' | Gly | Cys | (SEQ ID NO: 2652) |
| Pro | Gly | Thr | Cys | Xaa' | Gly | Glu | Xaa' | Ile | Cys | Ala | Tyr | Ala | Ala | Cys | Thr | Xaa' | Gly | Xaa' | Cys | (SEQ ID NO: 2653) |
| Pro | Gly | Thr | Cys | Xaa' | Gly | Glu | Xaa' | Ile | Cys | Ala | Tyr | Ala | Ala | Cys | Thr | Gly | Xaa' | Cys | Xaa' | (SEQ ID NO: 2654) |
| Pro | Gly | Thr | Cys | Xaa' | Gly | Glu | Xaa' | Ile | Cys | Ala | Tyr | Ala | Ala | Cys | Thr | Gly | Xaa' | Cys | | (SEQ ID NO: 2655) |
| Pro | Gly | Thr | Cys | Xaa' | Gly | Glu | Xaa' | Ile | Cys | Ala | Tyr | Ala | Ala | Cys | Thr | Gly | Xaa' | Xaa' | Cys | (SEQ ID NO: 2656) |

FIG. 2

```
Pro Gly Thr Cys Xaa' Gly Glu Xaa' Ile Cys Ala Tyr Ala Ala Cys Thr Gly Xaa' Cys Xaa'     (SEQ ID NO: 2657)
Pro Gly Thr Cys Xaa' Gly Glu Xaa' Ile Cys Ala Tyr Ala Ala Cys Thr Gly Cys Xaa'           (SEQ ID NO: 2658)
Pro Gly Thr Cys Xaa' Gly Glu Xaa' Ile Cys Ala Tyr Ala Ala Cys Thr Gly Cys Xaa' Xaa'      (SEQ ID NO: 2659)
Pro Gly Thr Cys Xaa' Gly Glu Ile Xaa' Cys Ala Tyr Ala Ala Cys Thr Gly Cys                (SEQ ID NO: 2660)
Pro Gly Thr Cys Xaa' Gly Glu Ile Ile Xaa' Cys Ala Tyr Ala Ala Cys Thr Gly Cys            (SEQ ID NO: 2661)
Pro Gly Thr Cys Xaa' Gly Glu Ile Ile Xaa' Xaa' Cys Ala Tyr Ala Ala Cys Thr Gly Cys       (SEQ ID NO: 2662)
Pro Gly Thr Cys Xaa' Gly Glu Ile Ile Xaa' Xaa' Cys Xaa' Ala Tyr Ala Ala Cys Thr Gly Cys  (SEQ ID NO: 2663)
Pro Gly Thr Cys Xaa' Gly Glu Ile Ile Xaa' Xaa' Cys Xaa' Ala Tyr Xaa' Ala Ala Cys Thr Gly Cys (SEQ ID NO: 2664)
Pro Gly Thr Cys Xaa' Gly Glu Ile Ile Xaa' Xaa' Cys Ala Tyr Xaa' Ala Ala Cys Thr Gly Cys  (SEQ ID NO: 2665)
Pro Gly Thr Cys Xaa' Gly Glu Ile Ile Xaa' Xaa' Cys Ala Tyr Xaa' Ala Xaa' Ala Cys Thr Gly Cys (SEQ ID NO: 2666)
Pro Gly Thr Cys Xaa' Gly Glu Ile Ile Xaa' Xaa' Cys Ala Tyr Ala Xaa' Cys Thr Gly Cys      (SEQ ID NO: 2667)
Pro Gly Thr Cys Xaa' Gly Glu Ile Ile Xaa' Xaa' Cys Ala Tyr Ala Ala Xaa' Cys Thr Gly Cys  (SEQ ID NO: 2668)
Pro Gly Thr Cys Xaa' Gly Glu Ile Ile Xaa' Xaa' Cys Ala Tyr Ala Ala Cys Xaa' Thr Gly Cys  (SEQ ID NO: 2669)
Pro Gly Thr Cys Xaa' Gly Glu Ile Ile Xaa' Xaa' Cys Ala Tyr Ala Ala Cys Thr Gly Xaa' Cys  (SEQ ID NO: 2670)
Pro Gly Thr Cys Xaa' Gly Glu Ile Ile Xaa' Xaa' Cys Ala Tyr Ala Ala Cys Thr Gly Cys Xaa'  (SEQ ID NO: 2671)
Pro Gly Thr Cys Xaa' Gly Glu Ile Ile Xaa' Cys Xaa' Ala Tyr Ala Ala Cys Thr Gly Cys       (SEQ ID NO: 2672)
Pro Gly Thr Cys Xaa' Gly Glu Ile Ile Xaa' Cys Xaa' Ala Tyr Xaa' Ala Ala Cys Thr Gly Cys  (SEQ ID NO: 2673)
Pro Gly Thr Cys Xaa' Gly Glu Ile Ile Xaa' Cys Xaa' Ala Tyr Ala Xaa' Ala Ala Cys Thr Gly Cys (SEQ ID NO: 2674)
Pro Gly Thr Cys Xaa' Gly Glu Ile Ile Xaa' Cys Xaa' Ala Tyr Ala Ala Xaa' Cys Thr Gly Cys  (SEQ ID NO: 2675)
Pro Gly Thr Cys Xaa' Gly Glu Ile Ile Xaa' Cys Xaa' Ala Tyr Ala Ala Cys Xaa' Thr Gly Cys  (SEQ ID NO: 2676)
Pro Gly Thr Cys Xaa' Gly Glu Ile Ile Xaa' Cys Xaa' Ala Tyr Ala Ala Cys Thr Gly Xaa' Cys  (SEQ ID NO: 2677)
Pro Gly Thr Cys Xaa' Gly Glu Ile Ile Xaa' Cys Xaa' Ala Tyr Ala Ala Cys Thr Gly Cys Xaa'  (SEQ ID NO: 2678)
Pro Gly Thr Cys Xaa' Gly Glu Ile Ile Xaa' Cys Ala Xaa' Tyr Ala Ala Cys Thr Gly Cys       (SEQ ID NO: 2679)
Pro Gly Thr Cys Xaa' Gly Glu Ile Ile Xaa' Cys Ala Xaa' Tyr Ala Ala Cys Thr Gly Cys Xaa'  (SEQ ID NO: 2680)
Pro Gly Thr Cys Xaa' Gly Glu Ile Ile Xaa' Cys Ala Tyr Xaa' Ala Ala Cys Thr Gly Cys       (SEQ ID NO: 2681)
Pro Gly Thr Cys Xaa' Gly Glu Ile Ile Xaa' Cys Ala Xaa' Tyr Ala Ala Cys Thr Gly Cys       (SEQ ID NO: 2682)
Pro Gly Thr Cys Xaa' Gly Glu Ile Ile Xaa' Cys Ala Xaa' Tyr Ala Xaa' Ala Ala Cys Thr Gly Cys (SEQ ID NO: 2683)
Pro Gly Thr Cys Xaa' Gly Glu Ile Ile Xaa' Cys Ala Xaa' Tyr Ala Ala Xaa' Cys Thr Gly Cys  (SEQ ID NO: 2684)
Pro Gly Thr Cys Xaa' Gly Glu Ile Ile Xaa' Cys Ala Xaa' Tyr Ala Ala Cys Xaa' Thr Gly Cys  (SEQ ID NO: 2685)
Pro Gly Thr Cys Xaa' Gly Glu Ile Ile Xaa' Cys Ala Xaa' Tyr Ala Ala Cys Thr Gly Xaa' Cys  (SEQ ID NO: 2686)
Pro Gly Thr Cys Xaa' Gly Glu Ile Ile Xaa' Cys Ala Xaa' Tyr Ala Ala Cys Thr Gly Cys Xaa'  (SEQ ID NO: 2687)
Pro Gly Thr Cys Xaa' Gly Glu Ile Ile Xaa' Cys Ala Tyr Xaa' Ala Ala Cys Thr Gly Cys       (SEQ ID NO: 2688)
Pro Gly Thr Cys Xaa' Gly Glu Ile Ile Xaa' Cys Ala Tyr Xaa' Ala Ala Cys Thr Gly Xaa' Cys  (SEQ ID NO: 2689)
Pro Gly Thr Cys Xaa' Gly Glu Ile Ile Xaa' Cys Ala Tyr Ala Ala Cys Thr Gly Cys Xaa'       (SEQ ID NO: 2690)
```

FIG. 2

```
Pro Gly Thr Cys Xaa' Gly Glu Ile Xaa' Cys Ala Tyr Xaa' Ala Ala Cys Thr Gly Cys   (SEQID NO: 2691)
Pro Gly Thr Cys Xaa' Gly Glu Ile Xaa' Cys Ala Tyr Xaa' Xaa' Ala Cys Thr Gly Cys   (SEQID NO: 2692)
Pro Gly Thr Cys Xaa' Gly Glu Ile Xaa' Cys Ala Tyr Xaa' Ala Xaa' Cys Thr Gly Cys   (SEQID NO: 2693)
Pro Gly Thr Cys Xaa' Gly Glu Ile Xaa' Cys Ala Tyr Xaa' Ala Ala Xaa' Thr Gly Cys   (SEQID NO: 2694)
Pro Gly Thr Cys Xaa' Gly Glu Ile Xaa' Cys Ala Tyr Xaa' Ala Ala Cys Xaa' Gly Cys   (SEQID NO: 2695)
Pro Gly Thr Cys Xaa' Gly Glu Ile Xaa' Cys Ala Tyr Xaa' Ala Ala Cys Thr Xaa' Cys   (SEQID NO: 2696)
Pro Gly Thr Cys Xaa' Gly Glu Ile Xaa' Cys Ala Tyr Xaa' Ala Ala Cys Thr Gly Xaa'   (SEQID NO: 2697)
Pro Gly Thr Cys Xaa' Gly Glu Ile Xaa' Cys Ala Tyr Xaa' Xaa' Xaa' Cys Thr Gly Cys   (SEQID NO: 2698)
Pro Gly Thr Cys Xaa' Gly Glu Ile Xaa' Cys Ala Tyr Xaa' Xaa' Ala Xaa' Thr Gly Cys   (SEQID NO: 2699)
Pro Gly Thr Cys Xaa' Gly Glu Ile Xaa' Cys Ala Tyr Xaa' Xaa' Ala Cys Xaa' Gly Cys   (SEQID NO: 2700)
Pro Gly Thr Cys Xaa' Gly Glu Ile Xaa' Cys Ala Tyr Xaa' Xaa' Ala Cys Thr Xaa' Cys   (SEQID NO: 2701)
Pro Gly Thr Cys Xaa' Gly Glu Ile Xaa' Cys Ala Tyr Xaa' Xaa' Ala Cys Thr Gly Xaa'   (SEQID NO: 2702)
Pro Gly Thr Cys Xaa' Gly Glu Ile Xaa' Cys Ala Tyr Xaa' Ala Xaa' Xaa' Thr Gly Cys   (SEQID NO: 2703)
Pro Gly Thr Cys Xaa' Gly Glu Ile Xaa' Cys Ala Tyr Xaa' Ala Xaa' Cys Xaa' Gly Cys   (SEQID NO: 2704)
Pro Gly Thr Cys Xaa' Gly Glu Ile Xaa' Cys Ala Tyr Xaa' Ala Xaa' Cys Thr Xaa' Cys   (SEQID NO: 2705)
Pro Gly Thr Cys Xaa' Gly Glu Ile Xaa' Cys Ala Tyr Xaa' Ala Xaa' Cys Thr Gly Xaa'   (SEQID NO: 2706)
Pro Gly Thr Cys Xaa' Gly Glu Ile Xaa' Cys Ala Tyr Xaa' Ala Ala Xaa' Xaa' Gly Cys   (SEQID NO: 2707)
Pro Gly Thr Cys Xaa' Gly Glu Ile Xaa' Cys Ala Tyr Xaa' Ala Ala Xaa' Thr Xaa' Cys   (SEQID NO: 2708)
Pro Gly Thr Cys Xaa' Gly Glu Ile Xaa' Cys Ala Tyr Xaa' Ala Ala Xaa' Thr Gly Xaa'   (SEQID NO: 2709)
Pro Gly Thr Cys Xaa' Gly Glu Ile Xaa' Cys Ala Tyr Xaa' Ala Ala Cys Xaa' Xaa' Cys   (SEQID NO: 2710)
Pro Gly Thr Cys Xaa' Gly Glu Ile Xaa' Cys Ala Tyr Xaa' Ala Ala Cys Xaa' Gly Xaa'   (SEQID NO: 2711)
Pro Gly Thr Cys Xaa' Gly Glu Ile Xaa' Cys Ala Tyr Xaa' Ala Ala Cys Thr Xaa' Xaa'   (SEQID NO: 2712)
Pro Gly Thr Cys Xaa' Gly Glu Ile Xaa' Cys Ala Tyr Xaa' Xaa' Xaa' Xaa' Thr Gly Cys   (SEQID NO: 2713)
Pro Gly Thr Cys Xaa' Gly Glu Ile Xaa' Cys Ala Tyr Xaa' Xaa' Xaa' Cys Xaa' Gly Cys   (SEQID NO: 2714)
Pro Gly Thr Cys Xaa' Gly Glu Ile Xaa' Cys Ala Tyr Xaa' Xaa' Xaa' Cys Thr Xaa' Cys   (SEQID NO: 2715)
Pro Gly Thr Cys Xaa' Gly Glu Ile Xaa' Cys Ala Tyr Xaa' Xaa' Xaa' Cys Thr Gly Xaa'   (SEQID NO: 2716)
Pro Gly Thr Cys Xaa' Gly Glu Ile Xaa' Cys Ala Tyr Xaa' Xaa' Ala Xaa' Xaa' Gly Cys   (SEQID NO: 2717)
Pro Gly Thr Cys Xaa' Gly Glu Ile Xaa' Cys Ala Tyr Xaa' Xaa' Ala Xaa' Thr Xaa' Cys   (SEQID NO: 2718)
Pro Gly Thr Cys Xaa' Gly Glu Ile Xaa' Cys Ala Tyr Xaa' Xaa' Ala Xaa' Thr Gly Xaa'   (SEQID NO: 2719)
Pro Gly Thr Cys Xaa' Gly Glu Ile Xaa' Cys Ala Tyr Xaa' Xaa' Ala Cys Xaa' Xaa' Cys   (SEQID NO: 2720)
Pro Gly Thr Cys Xaa' Gly Glu Ile Xaa' Cys Ala Tyr Xaa' Xaa' Ala Cys Xaa' Gly Xaa'   (SEQID NO: 2721)
Pro Gly Thr Cys Xaa' Gly Glu Ile Xaa' Cys Ala Tyr Xaa' Xaa' Ala Cys Thr Xaa' Xaa'   (SEQID NO: 2722)
Pro Gly Thr Cys Xaa' Gly Glu Ile Xaa' Cys Ala Tyr Xaa' Ala Xaa' Xaa' Xaa' Gly Cys   (SEQID NO: 2723)
Pro Gly Thr Cys Xaa' Gly Glu Ile Xaa' Cys Ala Tyr Xaa' Ala Ala Cys Thr Gly Xaa'   (SEQID NO: 2724)
```

| Sequence | SEQ ID NO |
|---|---|
| Pro Gly Thr Cys Xaa' Gly Glu Ile Xaa' Cys Ala Tyr Ala Ala Cys Thr Gly Cys Xaa' Xaa' | 2725 |
| Pro Gly Thr Cys Xaa' Gly Glu Ile Cys Xaa' Ala Tyr Ala Ala Cys Thr Gly Cys | 2726 |
| Pro Gly Thr Cys Xaa' Gly Glu Ile Cys Xaa' Xaa' Ala Tyr Ala Ala Cys Thr Gly Cys | 2727 |
| Pro Gly Thr Cys Xaa' Gly Glu Ile Cys Xaa' Xaa' Ala Tyr Ala Ala Cys Thr Gly Cys | 2728 |
| Pro Gly Thr Cys Xaa' Gly Glu Ile Cys Xaa' Xaa' Ala Tyr Ala Xaa' Ala Ala Cys Thr Gly Cys | 2729 |
| Pro Gly Thr Cys Xaa' Gly Glu Ile Cys Xaa' Xaa' Ala Tyr Xaa' Ala Ala Cys Thr Gly Cys | 2730 |
| Pro Gly Thr Cys Xaa' Gly Glu Ile Cys Xaa' Xaa' Ala Tyr Ala Ala Cys Thr Gly Cys | 2731 |
| Pro Gly Thr Cys Xaa' Gly Glu Ile Cys Xaa' Xaa' Ala Tyr Ala Ala Xaa' Cys Thr Gly Cys | 2732 |
| Pro Gly Thr Cys Xaa' Gly Glu Ile Cys Xaa' Xaa' Ala Tyr Ala Ala Cys Thr Gly Cys | 2733 |
| Pro Gly Thr Cys Xaa' Gly Glu Ile Cys Xaa' Xaa' Ala Tyr Ala Ala Cys Xaa' Thr Gly Cys | 2734 |
| Pro Gly Thr Cys Xaa' Gly Glu Ile Cys Xaa' Xaa' Ala Tyr Ala Ala Cys Thr Gly Cys | 2735 |
| Pro Gly Thr Cys Xaa' Gly Glu Ile Cys Xaa' Xaa' Ala Tyr Ala Ala Cys Thr Xaa' Gly Cys | 2736 |
| Pro Gly Thr Cys Xaa' Gly Glu Ile Cys Xaa' Xaa' Ala Tyr Ala Ala Cys Thr Gly Cys Xaa' | 2737 |
| Pro Gly Thr Cys Xaa' Gly Glu Ile Cys Ala Xaa' Xaa' Tyr Ala Ala Cys Thr Gly Cys | 2738 |
| Pro Gly Thr Cys Xaa' Gly Glu Ile Cys Xaa' Tyr Xaa' Ala Ala Ala Cys Thr Gly Cys | 2739 |
| Pro Gly Thr Cys Xaa' Gly Glu Ile Cys Xaa' Ala Xaa' Tyr Ala Ala Cys Thr Gly Cys | 2740 |
| Pro Gly Thr Cys Xaa' Gly Glu Ile Cys Xaa' Ala Xaa' Tyr Ala Ala Cys Thr Gly Cys | 2741 |
| Pro Gly Thr Cys Xaa' Gly Glu Ile Cys Xaa' Ala Tyr Ala Ala Xaa' Cys Thr Gly Cys | 2742 |
| Pro Gly Thr Cys Xaa' Gly Glu Ile Cys Xaa' Ala Tyr Xaa' Ala Ala Cys Thr Gly Cys | 2743 |
| Pro Gly Thr Cys Xaa' Gly Glu Ile Cys Xaa' Ala Tyr Ala Ala Cys Thr Gly Xaa' Cys | 2744 |
| Pro Gly Thr Cys Xaa' Gly Glu Ile Cys Xaa' Ala Tyr Ala Ala Cys Thr Gly Cys Xaa' | 2745 |
| Pro Gly Thr Cys Xaa' Gly Glu Ile Cys Ala Xaa' Tyr Xaa' Ala Ala Cys Thr Gly Cys | 2746 |
| Pro Gly Thr Cys Xaa' Gly Glu Ile Cys Xaa' Tyr Ala Xaa' Ala Ala Cys Thr Gly Cys | 2747 |
| Pro Gly Thr Cys Xaa' Gly Glu Ile Cys Xaa' Ala Tyr Ala Xaa' Ala Cys Thr Gly Cys | 2748 |
| Pro Gly Thr Cys Xaa' Gly Glu Ile Cys Xaa' Ala Tyr Ala Ala Xaa' Cys Thr Gly Cys | 2749 |
| Pro Gly Thr Cys Xaa' Gly Glu Ile Cys Xaa' Ala Tyr Ala Ala Cys Thr Gly Cys | 2750 |
| Pro Gly Thr Cys Xaa' Gly Glu Ile Cys Xaa' Ala Tyr Ala Ala Xaa' Cys Thr Gly Cys | 2751 |
| Pro Gly Thr Cys Xaa' Gly Glu Ile Cys Xaa' Ala Tyr Ala Ala Cys Thr Gly Xaa' Cys | 2752 |
| Pro Gly Thr Cys Xaa' Gly Glu Ile Cys Xaa' Ala Tyr Ala Ala Cys Thr Gly Cys Xaa' | 2753 |
| Pro Gly Thr Cys Xaa' Gly Glu Ile Cys Xaa' Xaa' Tyr Ala Ala Ala Cys Thr Gly Cys | 2754 |
| Pro Gly Thr Cys Xaa' Gly Glu Ile Cys Xaa' Ala Xaa' Tyr Ala Ala Cys Thr Gly Cys | 2755 |
| Pro Gly Thr Cys Xaa' Gly Glu Ile Cys Xaa' Ala Xaa' Ala Tyr Ala Cys Thr Gly Cys | 2756 |
| Pro Gly Thr Cys Xaa' Gly Glu Ile Cys Xaa' Ala Xaa' Tyr Ala Ala Cys Thr Gly Cys | 2757 |
| Pro Gly Thr Cys Xaa' Gly Glu Ile Cys Xaa' Ala Tyr Ala Xaa' Ala Cys Thr Gly Cys | 2758 |

Pro Gly Thr Cys Xaa' Gly Glu Ile Cys Xaa' Ala Tyr Ala Xaa' Ala Cys Thr Gly Xaa' Cys (SEQID NO: 2759)
Pro Gly Thr Cys Xaa' Gly Glu Ile Cys Xaa' Ala Tyr Ala Xaa' Ala Cys Thr Gly Cys Xaa' (SEQID NO: 2760)
Pro Gly Thr Cys Xaa' Gly Glu Ile Cys Xaa' Ala Tyr Ala Xaa' Ala Xaa' Cys Thr Gly Cys (SEQID NO: 2761)
Pro Gly Thr Cys Xaa' Gly Glu Ile Cys Xaa' Ala Tyr Ala Xaa' Xaa' Cys Thr Gly Cys (SEQID NO: 2762)
Pro Gly Thr Cys Xaa' Gly Glu Ile Cys Xaa' Ala Tyr Ala Ala Xaa' Cys Xaa' Thr Gly Cys (SEQID NO: 2763)
Pro Gly Thr Cys Xaa' Gly Glu Ile Cys Xaa' Ala Tyr Ala Ala Xaa' Cys Thr Xaa' Gly Cys (SEQID NO: 2764)
Pro Gly Thr Cys Xaa' Gly Glu Ile Cys Xaa' Ala Tyr Ala Ala Xaa' Cys Thr Gly Xaa' Cys (SEQID NO: 2765)
Pro Gly Thr Cys Xaa' Gly Glu Ile Cys Xaa' Ala Tyr Ala Ala Xaa' Cys Thr Gly Cys Xaa' (SEQID NO: 2766)
Pro Gly Thr Cys Xaa' Gly Glu Ile Cys Xaa' Ala Tyr Ala Ala Xaa' Xaa' Cys Thr Gly Cys (SEQID NO: 2767)
Pro Gly Thr Cys Xaa' Gly Glu Ile Cys Xaa' Ala Tyr Ala Ala Cys Xaa' Xaa' Thr Gly Cys (SEQID NO: 2768)
Pro Gly Thr Cys Xaa' Gly Glu Ile Cys Xaa' Ala Tyr Ala Ala Cys Xaa' Thr Xaa' Gly Cys (SEQID NO: 2769)
Pro Gly Thr Cys Xaa' Gly Glu Ile Cys Xaa' Ala Tyr Ala Ala Cys Xaa' Thr Gly Xaa' Cys (SEQID NO: 2770)
Pro Gly Thr Cys Xaa' Gly Glu Ile Cys Xaa' Ala Tyr Ala Ala Cys Xaa' Thr Gly Cys Xaa' (SEQID NO: 2771)
Pro Gly Thr Cys Xaa' Gly Glu Ile Cys Xaa' Ala Tyr Ala Ala Cys Thr Xaa' Xaa' Gly Cys (SEQID NO: 2772)
Pro Gly Thr Cys Xaa' Gly Glu Ile Cys Xaa' Ala Tyr Ala Ala Cys Thr Xaa' Gly Xaa' Cys (SEQID NO: 2773)
Pro Gly Thr Cys Xaa' Gly Glu Ile Cys Xaa' Ala Tyr Ala Ala Cys Thr Xaa' Gly Cys Xaa' (SEQID NO: 2774)
Pro Gly Thr Cys Xaa' Gly Glu Ile Cys Xaa' Ala Tyr Ala Ala Cys Thr Gly Xaa' Xaa' Cys (SEQID NO: 2775)
Pro Gly Thr Cys Xaa' Gly Glu Ile Cys Xaa' Ala Tyr Ala Ala Cys Thr Gly Xaa' Cys Xaa' (SEQID NO: 2776)
Pro Gly Thr Cys Xaa' Gly Glu Ile Cys Xaa' Ala Tyr Ala Ala Cys Thr Gly Cys Xaa' Xaa' (SEQID NO: 2777)
Pro Gly Thr Cys Xaa' Gly Glu Ile Cys Ala Xaa' Xaa' Ala Ala Cys Thr Gly Cys Xaa' (SEQID NO: 2778)
Pro Gly Thr Cys Xaa' Gly Glu Ile Cys Ala Xaa' Tyr Xaa' Ala Ala Cys Thr Gly Cys Xaa' (SEQID NO: 2779)
Pro Gly Thr Cys Xaa' Gly Glu Ile Cys Ala Xaa' Tyr Ala Xaa' Ala Cys Thr Gly Cys Xaa' (SEQID NO: 2780)
Pro Gly Thr Cys Xaa' Gly Glu Ile Cys Ala Xaa' Tyr Ala Ala Xaa' Cys Thr Gly Cys (SEQID NO: 2781)
Pro Gly Thr Cys Xaa' Gly Glu Ile Cys Ala Xaa' Tyr Ala Ala Cys Xaa' Thr Gly Cys (SEQID NO: 2782)
Pro Gly Thr Cys Xaa' Gly Glu Ile Cys Ala Xaa' Tyr Ala Ala Cys Thr Xaa' Ala Cys Thr Gly Cys (SEQID NO: 2783)
Pro Gly Thr Cys Xaa' Gly Glu Ile Cys Ala Xaa' Tyr Xaa' Ala Ala Cys Thr Gly Cys (SEQID NO: 2784)
Pro Gly Thr Cys Xaa' Gly Glu Ile Cys Ala Xaa' Tyr Xaa' Ala Ala Cys Thr Gly Cys (SEQID NO: 2791 )
Pro Gly Thr Cys Xaa' Gly Glu Ile Cys Ala Xaa' Tyr Xaa' Xaa' Ala Ala Cys Thr Gly Cys (SEQID NO: 2792 )

FIG. 2

| Sequence | SEQ ID NO |
|---|---|
| Pro Gly Thr Cys Xaa' Gly Glu Ile Cys Ala Xaa' Tyr Xaa' Ala Xaa' Ala Cys Thr Gly Cys | 2793 |
| Pro Gly Thr Cys Xaa' Gly Glu Ile Cys Ala Xaa' Tyr Xaa' Ala Ala Xaa' Cys Thr Gly Cys | 2794 |
| Pro Gly Thr Cys Xaa' Gly Glu Ile Cys Ala Xaa' Tyr Xaa' Ala Ala Cys Xaa' Thr Gly Cys | 2795 |
| Pro Gly Thr Cys Xaa' Gly Glu Ile Cys Ala Xaa' Tyr Xaa' Ala Ala Cys Thr Xaa' Gly Cys | 2796 |
| Pro Gly Thr Cys Xaa' Gly Glu Ile Cys Ala Xaa' Tyr Xaa' Ala Ala Cys Thr Gly Xaa' Cys | 2797 |
| Pro Gly Thr Cys Xaa' Gly Glu Ile Cys Ala Xaa' Tyr Xaa' Ala Ala Cys Thr Gly Cys Xaa' | 2798 |
| Pro Gly Thr Cys Xaa' Gly Glu Ile Cys Ala Xaa' Tyr Ala Xaa' Ala Cys Thr Gly Cys | 2799 |
| Pro Gly Thr Cys Xaa' Gly Glu Ile Cys Ala Xaa' Tyr Ala Xaa' Ala Xaa' Cys Thr Gly Cys | 2800 |
| Pro Gly Thr Cys Xaa' Gly Glu Ile Cys Ala Xaa' Tyr Ala Xaa' Ala Cys Xaa' Thr Gly Cys | 2801 |
| Pro Gly Thr Cys Xaa' Gly Glu Ile Cys Ala Xaa' Tyr Ala Xaa' Ala Cys Thr Xaa' Gly Cys | 2802 |
| Pro Gly Thr Cys Xaa' Gly Glu Ile Cys Ala Xaa' Tyr Ala Xaa' Ala Cys Thr Gly Xaa' Cys | 2803 |
| Pro Gly Thr Cys Xaa' Gly Glu Ile Cys Ala Xaa' Tyr Ala Xaa' Ala Cys Thr Gly Cys Xaa' | 2804 |
| Pro Gly Thr Cys Xaa' Gly Glu Ile Cys Ala Xaa' Tyr Ala Ala Xaa' Cys Thr Gly Cys | 2805 |
| Pro Gly Thr Cys Xaa' Gly Glu Ile Cys Ala Xaa' Tyr Ala Ala Xaa' Cys Thr Gly Cys | 2806 |
| Pro Gly Thr Cys Xaa' Gly Glu Ile Cys Ala Ala Xaa' Cys Thr Gly Cys | 2807 |
| Pro Gly Thr Cys Xaa' Gly Glu Ile Cys Ala Xaa' Tyr Ala Ala Xaa' Cys Xaa' Thr Gly Cys | 2808 |
| Pro Gly Thr Cys Xaa' Gly Glu Ile Cys Ala Xaa' Tyr Ala Ala Xaa' Cys Thr Xaa' Gly Cys | 2809 |
| Pro Gly Thr Cys Xaa' Gly Glu Ile Cys Ala Xaa' Tyr Ala Ala Xaa' Cys Thr Gly Xaa' Cys | 2810 |
| Pro Gly Thr Cys Xaa' Gly Glu Ile Cys Ala Xaa' Tyr Ala Ala Xaa' Cys Thr Gly Cys Xaa' | 2811 |
| Pro Gly Thr Cys Xaa' Gly Glu Ile Cys Ala Xaa' Tyr Ala Ala Cys Xaa' Thr Gly Cys | 2812 |
| Pro Gly Thr Cys Xaa' Gly Glu Ile Cys Ala Xaa' Tyr Ala Ala Cys Xaa' Xaa' Thr Gly Cys | 2813 |
| Pro Gly Thr Cys Xaa' Gly Glu Ile Cys Ala Xaa' Tyr Ala Ala Cys Xaa' Thr Xaa' Gly Cys | 2814 |
| Pro Gly Thr Cys Xaa' Gly Glu Ile Cys Ala Xaa' Tyr Ala Ala Cys Xaa' Thr Gly Xaa' Cys | 2815 |
| Pro Gly Thr Cys Xaa' Gly Glu Ile Cys Ala Xaa' Tyr Ala Ala Cys Xaa' Thr Gly Cys Xaa' | 2816 |
| Pro Gly Thr Cys Xaa' Gly Glu Ile Cys Ala Xaa' Tyr Ala Ala Cys Thr Xaa' Gly Cys | 2817 |
| Pro Gly Thr Cys Xaa' Gly Glu Ile Cys Ala Xaa' Tyr Ala Ala Cys Thr Xaa' Xaa' Gly Cys | 2818 |
| Pro Gly Thr Cys Xaa' Gly Glu Ile Cys Ala Xaa' Tyr Ala Ala Cys Thr Xaa' Gly Xaa' Cys | 2819 |
| Pro Gly Thr Cys Xaa' Gly Glu Ile Cys Ala Xaa' Tyr Ala Ala Cys Thr Xaa' Gly Cys Xaa' | 2820 |
| Pro Gly Thr Cys Xaa' Gly Glu Ile Cys Ala Xaa' Tyr Ala Ala Cys Thr Gly Xaa' Cys | 2821 |
| Pro Gly Thr Cys Xaa' Gly Glu Ile Cys Ala Xaa' Tyr Ala Ala Cys Thr Gly Xaa' Xaa' Cys | 2822 |
| Pro Gly Thr Cys Xaa' Gly Glu Ile Cys Ala Xaa' Tyr Ala Ala Cys Thr Gly Cys Xaa' | 2823 |
| Pro Gly Thr Cys Xaa' Gly Glu Ile Cys Ala Xaa' Tyr Ala Ala Cys Thr Gly Cys Xaa' Xaa' | 2824 |
| Pro Gly Thr Cys Xaa' Gly Glu Ile Cys Ala Tyr Xaa' Ala Ala Cys Thr Gly Cys | 2825 |
| Pro Gly Thr Cys Xaa' Gly Glu Ile Cys Ala Tyr Xaa' Ala Ala Cys Thr Gly Cys | 2826 |

FIG. 2

Pro Gly Thr Cys Xaa' Gly Glu Ile Cys Ala Tyr Xaa' Xaa' Ala Ala Cys Thr Gly Cys (SEQID NO: 2827)
Pro Gly Thr Cys Xaa' Gly Glu Ile Cys Ala Tyr Xaa' Xaa' Ala Ala Cys Thr Gly Cys (SEQID NO: 2828)
Pro Gly Thr Cys Xaa' Gly Glu Ile Cys Ala Tyr Xaa' Xaa' Ala Xaa' Ala Cys Thr Gly Cys (SEQID NO: 2829)
Pro Gly Thr Cys Xaa' Gly Glu Ile Cys Ala Tyr Xaa' Xaa' Ala Ala Xaa' Cys Thr Gly Cys (SEQID NO: 2830)
Pro Gly Thr Cys Xaa' Gly Glu Ile Cys Ala Tyr Xaa' Xaa' Ala Ala Ala Xaa' Cys Thr Gly Cys (SEQID NO: 2831)
Pro Gly Thr Cys Xaa' Gly Glu Ile Cys Ala Tyr Xaa' Xaa' Ala Ala Ala Cys Xaa' Thr Gly Cys (SEQID NO: 2832)
Pro Gly Thr Cys Xaa' Gly Glu Ile Cys Ala Tyr Xaa' Xaa' Ala Ala Ala Cys Thr Xaa' Gly Cys (SEQID NO: 2833)
Pro Gly Thr Cys Xaa' Gly Glu Ile Cys Ala Tyr Xaa' Xaa' Ala Ala Ala Cys Thr Gly Xaa' Cys (SEQID NO: 2834)
Pro Gly Thr Cys Xaa' Gly Glu Ile Cys Ala Tyr Xaa' Xaa' Ala Ala Ala Cys Thr Gly Cys Xaa' (SEQID NO: 2835)
Pro Gly Thr Cys Xaa' Gly Glu Ile Cys Ala Tyr Xaa' Ala Xaa' Xaa' Ala Cys Thr Gly Cys (SEQID NO: 2836)
Pro Gly Thr Cys Xaa' Gly Glu Ile Cys Ala Tyr Xaa' Ala Xaa' Ala Xaa' Cys Thr Gly Cys (SEQID NO: 2837)
Pro Gly Thr Cys Xaa' Gly Glu Ile Cys Ala Tyr Xaa' Ala Xaa' Ala Ala Xaa' Cys Thr Gly Cys (SEQID NO: 2838)
Pro Gly Thr Cys Xaa' Gly Glu Ile Cys Ala Tyr Xaa' Ala Xaa' Ala Cys Xaa' Thr Gly Cys (SEQID NO: 2839)
Pro Gly Thr Cys Xaa' Gly Glu Ile Cys Ala Tyr Xaa' Ala Xaa' Ala Cys Thr Xaa' Gly Cys (SEQID NO: 2840)
Pro Gly Thr Cys Xaa' Gly Glu Ile Cys Ala Tyr Xaa' Ala Xaa' Ala Cys Thr Gly Xaa' Cys (SEQID NO: 2841)
Pro Gly Thr Cys Xaa' Gly Glu Ile Cys Ala Tyr Xaa' Ala Xaa' Ala Cys Thr Gly Cys Xaa' (SEQID NO: 2842)
Pro Gly Thr Cys Xaa' Gly Glu Ile Cys Ala Tyr Xaa' Ala Ala Xaa' Xaa' Cys Thr Gly Cys (SEQID NO: 2843)
Pro Gly Thr Cys Xaa' Gly Glu Ile Cys Ala Tyr Xaa' Ala Ala Xaa' Cys Xaa' Thr Gly Cys (SEQID NO: 2844)
Pro Gly Thr Cys Xaa' Gly Glu Ile Cys Ala Tyr Xaa' Ala Ala Xaa' Cys Thr Xaa' Gly Cys (SEQID NO: 2845)
Pro Gly Thr Cys Xaa' Gly Glu Ile Cys Ala Tyr Xaa' Ala Ala Xaa' Cys Thr Gly Xaa' Cys (SEQID NO: 2846)
Pro Gly Thr Cys Xaa' Gly Glu Ile Cys Ala Tyr Xaa' Ala Ala Xaa' Cys Thr Gly Cys Xaa' (SEQID NO: 2847)
Pro Gly Thr Cys Xaa' Gly Glu Ile Cys Ala Tyr Xaa' Ala Ala Ala Xaa' Cys Xaa' Thr Gly Cys (SEQID NO: 2848)
Pro Gly Thr Cys Xaa' Gly Glu Ile Cys Ala Tyr Xaa' Ala Ala Ala Xaa' Cys Thr Xaa' Gly Cys (SEQID NO: 2849)
Pro Gly Thr Cys Xaa' Gly Glu Ile Cys Ala Tyr Xaa' Ala Ala Ala Xaa' Cys Thr Gly Xaa' Cys (SEQID NO: 2850)
Pro Gly Thr Cys Xaa' Gly Glu Ile Cys Ala Tyr Xaa' Ala Ala Ala Xaa' Cys Thr Gly Cys Xaa' (SEQID NO: 2851)
Pro Gly Thr Cys Xaa' Gly Glu Ile Cys Ala Tyr Xaa' Ala Ala Ala Cys Xaa' Xaa' Thr Gly Cys (SEQID NO: 2852)
Pro Gly Thr Cys Xaa' Gly Glu Ile Cys Ala Tyr Xaa' Ala Ala Ala Cys Xaa' Thr Xaa' Gly Cys (SEQID NO: 2853)
Pro Gly Thr Cys Xaa' Gly Glu Ile Cys Ala Tyr Xaa' Ala Ala Ala Cys Xaa' Thr Gly Xaa' Cys (SEQID NO: 2854)
Pro Gly Thr Cys Xaa' Gly Glu Ile Cys Ala Tyr Xaa' Ala Ala Ala Cys Xaa' Thr Gly Cys Xaa' (SEQID NO: 2855)
Pro Gly Thr Cys Xaa' Gly Glu Ile Cys Ala Tyr Xaa' Ala Ala Ala Cys Thr Xaa' Xaa' Gly Cys (SEQID NO: 2856)
Pro Gly Thr Cys Xaa' Gly Glu Ile Cys Ala Tyr Xaa' Ala Ala Ala Cys Thr Xaa' Gly Cys (SEQID NO: 2857)
Pro Gly Thr Cys Xaa' Gly Glu Ile Cys Ala Tyr Xaa' Ala Ala Ala Cys Thr Xaa' Gly Cys Xaa' (SEQID NO: 2858)
Pro Gly Thr Cys Xaa' Gly Glu Ile Cys Ala Tyr Xaa' Ala Ala Ala Cys Thr Gly Xaa' Cys Xaa' (SEQID NO: 2859)
Pro Gly Thr Cys Xaa' Gly Glu Ile Cys Ala Tyr Xaa' Ala Ala Ala Cys Thr Gly Cys Xaa' (SEQID NO: 2860)

FIG. 2

| | | | | | | | | | | | | |
|---|---|---|---|---|---|---|---|---|---|---|---|---|
| Pro | Gly | Thr | Cys | Xaa' | Gly | Glu | Ile | Cys | Ala | Tyr | Xaa' | Ala | Ala | Cys | Thr | Gly | Cys | Xaa' | Xaa' | (SEQ ID NO: 2861) |
| Pro | Gly | Thr | Cys | Xaa' | Gly | Glu | Ile | Cys | Ala | Tyr | Ala | Ala | Xaa' | Ala | Cys | Thr | Gly | Cys | | (SEQ ID NO: 2862) |
| Pro | Gly | Thr | Cys | Xaa' | Gly | Glu | Ile | Cys | Ala | Tyr | Ala | Ala | Xaa' | Xaa' | Ala | Cys | Thr | Gly | Cys | (SEQ ID NO: 2863) |
| Pro | Gly | Thr | Cys | Xaa' | Gly | Glu | Ile | Cys | Ala | Tyr | Ala | Ala | Xaa' | Xaa' | Ala | Cys | Thr | Gly | Cys | (SEQ ID NO: 2864) |
| Pro | Gly | Thr | Cys | Xaa' | Gly | Glu | Ile | Cys | Ala | Tyr | Ala | Ala | Xaa' | Xaa' | Ala | Cys | Xaa' | Thr | Gly | Cys | (SEQ ID NO: 2865) |
| Pro | Gly | Thr | Cys | Xaa' | Gly | Glu | Ile | Cys | Ala | Tyr | Ala | Ala | Xaa' | Xaa' | Ala | Cys | Xaa' | Thr | Gly | Cys | (SEQ ID NO: 2866) |
| Pro | Gly | Thr | Cys | Xaa' | Gly | Glu | Ile | Cys | Ala | Tyr | Ala | Ala | Xaa' | Xaa' | Ala | Cys | Thr | Gly | Xaa' | Cys | (SEQ ID NO: 2867) |
| Pro | Gly | Thr | Cys | Xaa' | Gly | Glu | Ile | Cys | Ala | Tyr | Ala | Ala | Xaa' | Xaa' | Ala | Cys | Thr | Gly | Xaa' | Cys | (SEQ ID NO: 2868) |
| Pro | Gly | Thr | Cys | Xaa' | Gly | Glu | Ile | Cys | Ala | Tyr | Ala | Ala | Xaa' | Xaa' | Ala | Cys | Thr | Gly | Cys | Xaa' | (SEQ ID NO: 2869) |
| Pro | Gly | Thr | Cys | Xaa' | Gly | Glu | Ile | Cys | Ala | Tyr | Ala | Ala | Xaa' | Xaa' | Ala | Cys | Thr | Gly | Cys | | (SEQ ID NO: 2870) |
| Pro | Gly | Thr | Cys | Xaa' | Gly | Glu | Ile | Cys | Ala | Tyr | Ala | Ala | Xaa' | Xaa' | Ala | Xaa' | Cys | Thr | Gly | Cys | (SEQ ID NO: 2871) |
| Pro | Gly | Thr | Cys | Xaa' | Gly | Glu | Ile | Cys | Ala | Tyr | Ala | Ala | Xaa' | Xaa' | Ala | Xaa' | Cys | Thr | Gly | Cys | (SEQ ID NO: 2872) |
| Pro | Gly | Thr | Cys | Xaa' | Gly | Glu | Ile | Cys | Ala | Tyr | Ala | Ala | Xaa' | Xaa' | Ala | Xaa' | Cys | Thr | Gly | Cys | (SEQ ID NO: 2873) |
| Pro | Gly | Thr | Cys | Xaa' | Gly | Glu | Ile | Cys | Ala | Tyr | Ala | Ala | Xaa' | Xaa' | Ala | Xaa' | Cys | Thr | Gly | Xaa' | Cys | (SEQ ID NO: 2874) |
| Pro | Gly | Thr | Cys | Xaa' | Gly | Glu | Ile | Cys | Ala | Tyr | Ala | Ala | Xaa' | Xaa' | Ala | Xaa' | Cys | Thr | Gly | Cys | Xaa' | (SEQ ID NO: 2875) |
| Pro | Gly | Thr | Cys | Xaa' | Gly | Glu | Ile | Cys | Ala | Tyr | Ala | Ala | Xaa' | Xaa' | Ala | Cys | Xaa' | Thr | Gly | Cys | | (SEQ ID NO: 2876) |
| Pro | Gly | Thr | Cys | Xaa' | Gly | Glu | Ile | Cys | Ala | Tyr | Ala | Ala | Xaa' | Xaa' | Ala | Cys | Xaa' | Xaa' | Thr | Gly | Cys | (SEQ ID NO: 2877) |
| Pro | Gly | Thr | Cys | Xaa' | Gly | Glu | Ile | Cys | Ala | Tyr | Ala | Ala | Xaa' | Xaa' | Ala | Cys | Xaa' | Thr | Xaa' | Gly | Cys | (SEQ ID NO: 2878) |
| Pro | Gly | Thr | Cys | Xaa' | Gly | Glu | Ile | Cys | Ala | Tyr | Ala | Ala | Xaa' | Xaa' | Ala | Cys | Xaa' | Thr | Gly | Xaa' | Cys | (SEQ ID NO: 2879) |
| Pro | Gly | Thr | Cys | Xaa' | Gly | Glu | Ile | Cys | Ala | Tyr | Ala | Ala | Xaa' | Xaa' | Ala | Cys | Xaa' | Thr | Gly | Cys | Xaa' | (SEQ ID NO: 2880) |
| Pro | Gly | Thr | Cys | Xaa' | Gly | Glu | Ile | Cys | Ala | Tyr | Ala | Ala | Xaa' | Xaa' | Ala | Cys | Thr | Xaa' | Gly | Cys | | (SEQ ID NO: 2881) |
| Pro | Gly | Thr | Cys | Xaa' | Gly | Glu | Ile | Cys | Ala | Tyr | Ala | Ala | Xaa' | Xaa' | Ala | Cys | Thr | Xaa' | Xaa' | Gly | Cys | (SEQ ID NO: 2882) |
| Pro | Gly | Thr | Cys | Xaa' | Gly | Glu | Ile | Cys | Ala | Tyr | Ala | Ala | Xaa' | Xaa' | Ala | Cys | Thr | Xaa' | Gly | Xaa' | Cys | (SEQ ID NO: 2883) |
| Pro | Gly | Thr | Cys | Xaa' | Gly | Glu | Ile | Cys | Ala | Tyr | Ala | Ala | Xaa' | Xaa' | Ala | Cys | Thr | Xaa' | Gly | Cys | Xaa' | (SEQ ID NO: 2884) |
| Pro | Gly | Thr | Cys | Xaa' | Gly | Glu | Ile | Cys | Ala | Tyr | Ala | Ala | Xaa' | Xaa' | Ala | Cys | Thr | Gly | Xaa' | Cys | | (SEQ ID NO: 2885) |
| Pro | Gly | Thr | Cys | Xaa' | Gly | Glu | Ile | Cys | Ala | Tyr | Ala | Ala | Xaa' | Xaa' | Ala | Cys | Thr | Gly | Xaa' | Xaa' | Cys | (SEQ ID NO: 2886) |
| Pro | Gly | Thr | Cys | Xaa' | Gly | Glu | Ile | Cys | Ala | Tyr | Ala | Ala | Xaa' | Xaa' | Ala | Cys | Thr | Gly | Xaa' | Cys | Xaa' | (SEQ ID NO: 2887) |
| Pro | Gly | Thr | Cys | Xaa' | Gly | Glu | Ile | Cys | Ala | Tyr | Ala | Ala | Xaa' | Xaa' | Ala | Cys | Thr | Gly | Cys | Xaa' | | (SEQ ID NO: 2888) |
| Pro | Gly | Thr | Cys | Xaa' | Gly | Glu | Ile | Cys | Ala | Tyr | Ala | Ala | Xaa' | Xaa' | Ala | Cys | Thr | Gly | Cys | Xaa' | Xaa' | (SEQ ID NO: 2889) |
| Pro | Gly | Thr | Cys | Xaa' | Gly | Glu | Ile | Cys | Ala | Tyr | Ala | Ala | Xaa' | Ala | Ala | Xaa' | Cys | Thr | Gly | Cys | | (SEQ ID NO: 2890) |
| Pro | Gly | Thr | Cys | Xaa' | Gly | Glu | Ile | Cys | Ala | Tyr | Ala | Ala | Xaa' | Ala | Ala | Cys | Thr | Gly | Cys | | (SEQ ID NO: 2891) |
| Pro | Gly | Thr | Cys | Xaa' | Gly | Glu | Ile | Cys | Ala | Tyr | Ala | Ala | Xaa' | Ala | Ala | Xaa' | Cys | Thr | Gly | Cys | (SEQ ID NO: 2892) |
| Pro | Gly | Thr | Cys | Xaa' | Gly | Glu | Ile | Cys | Ala | Tyr | Ala | Ala | Xaa' | Ala | Ala | Xaa' | Cys | Xaa' | Thr | Gly | Cys | (SEQ ID NO: 2893) |
| Pro | Gly | Thr | Cys | Xaa' | Gly | Glu | Ile | Cys | Ala | Tyr | Ala | Ala | Xaa' | Ala | Ala | Xaa' | Cys | Thr | Xaa' | Gly | Cys | (SEQ ID NO: 2894) |

FIG. 2

```
Pro Gly Thr Cys Xaa' Gly Glu Ile Cys Ala Tyr Ala Ala Xaa' Xaa' Cys Thr Gly Xaa' Cys       (SEQID NO: 2895)
Pro Gly Thr Cys Xaa' Gly Glu Ile Cys Ala Tyr Ala Ala Xaa' Xaa' Cys Thr Gly Cys Xaa'       (SEQID NO: 2896)
Pro Gly Thr Cys Xaa' Gly Glu Ile Cys Ala Tyr Ala Ala Xaa' Cys Xaa' Thr Gly Cys             (SEQID NO: 2897)
Pro Gly Thr Cys Xaa' Gly Glu Ile Cys Ala Tyr Ala Ala Xaa' Cys Xaa' Xaa' Thr Gly Cys       (SEQID NO: 2898)
Pro Gly Thr Cys Xaa' Gly Glu Ile Cys Ala Tyr Ala Ala Xaa' Cys Xaa' Thr Xaa' Gly Cys       (SEQID NO: 2899)
Pro Gly Thr Cys Xaa' Gly Glu Ile Cys Ala Tyr Ala Ala Xaa' Cys Xaa' Thr Gly Xaa' Cys       (SEQID NO: 2900)
Pro Gly Thr Cys Xaa' Gly Glu Ile Cys Ala Tyr Ala Ala Xaa' Cys Xaa' Thr Gly Cys Xaa'       (SEQID NO: 2901)
Pro Gly Thr Cys Xaa' Gly Glu Ile Cys Ala Tyr Ala Ala Xaa' Cys Thr Xaa' Gly Cys             (SEQID NO: 2902)
Pro Gly Thr Cys Xaa' Gly Glu Ile Cys Ala Tyr Ala Ala Xaa' Cys Thr Xaa' Xaa' Gly Cys       (SEQID NO: 2903)
Pro Gly Thr Cys Xaa' Gly Glu Ile Cys Ala Tyr Ala Ala Xaa' Cys Thr Xaa' Gly Xaa' Cys       (SEQID NO: 2904)
Pro Gly Thr Cys Xaa' Gly Glu Ile Cys Ala Tyr Ala Ala Xaa' Cys Thr Xaa' Gly Cys Xaa'       (SEQID NO: 2905)
Pro Gly Thr Cys Xaa' Gly Glu Ile Cys Ala Tyr Ala Ala Xaa' Cys Thr Gly Xaa' Cys             (SEQID NO: 2906)
Pro Gly Thr Cys Xaa' Gly Glu Ile Cys Ala Tyr Ala Ala Xaa' Cys Thr Gly Xaa' Xaa' Cys       (SEQID NO: 2907)
Pro Gly Thr Cys Xaa' Gly Glu Ile Cys Ala Tyr Ala Ala Xaa' Cys Thr Gly Xaa' Cys Xaa'       (SEQID NO: 2908)
Pro Gly Thr Cys Xaa' Gly Glu Ile Cys Ala Tyr Ala Ala Xaa' Cys Thr Gly Cys Xaa'             (SEQID NO: 2909)
Pro Gly Thr Cys Xaa' Gly Glu Ile Cys Ala Tyr Ala Ala Xaa' Cys Thr Gly Cys Xaa' Xaa'       (SEQID NO: 2910)
Pro Gly Thr Cys Xaa' Gly Glu Ile Cys Ala Ala Cys Xaa' Xaa' Xaa' Thr Gly Cys                 (SEQID NO: 2911)
Pro Gly Thr Cys Xaa' Gly Glu Ile Cys Ala Tyr Ala Ala Cys Xaa' Xaa' Xaa' Thr Gly Cys       (SEQID NO: 2912)
Pro Gly Thr Cys Xaa' Gly Glu Ile Cys Ala Tyr Ala Ala Cys Xaa' Xaa' Xaa' Thr Xaa' Gly Cys (SEQID NO: 2913)
Pro Gly Thr Cys Xaa' Gly Glu Ile Cys Ala Tyr Ala Ala Cys Xaa' Xaa' Xaa' Thr Gly Xaa' Cys (SEQID NO: 2914)
Pro Gly Thr Cys Xaa' Gly Glu Ile Cys Ala Tyr Ala Ala Cys Xaa' Xaa' Xaa' Thr Gly Cys Xaa' (SEQID NO: 2915)
Pro Gly Thr Cys Xaa' Gly Glu Ile Cys Ala Tyr Ala Ala Cys Xaa' Xaa' Thr Xaa' Gly Cys       (SEQID NO: 2916)
Pro Gly Thr Cys Xaa' Gly Glu Ile Cys Ala Tyr Ala Ala Cys Xaa' Xaa' Thr Gly Xaa' Cys       (SEQID NO: 2917)
Pro Gly Thr Cys Xaa' Gly Glu Ile Cys Ala Tyr Ala Ala Cys Xaa' Xaa' Thr Gly Cys Xaa'       (SEQID NO: 2918)
Pro Gly Thr Cys Xaa' Gly Glu Ile Cys Ala Tyr Ala Ala Cys Xaa' Thr Xaa' Xaa' Gly Cys       (SEQID NO: 2919)
Pro Gly Thr Cys Xaa' Gly Glu Ile Cys Ala Tyr Ala Ala Cys Xaa' Thr Xaa' Gly Xaa' Cys       (SEQID NO: 2920)
Pro Gly Thr Cys Xaa' Gly Glu Ile Cys Ala Tyr Ala Ala Cys Xaa' Thr Xaa' Gly Cys Xaa'       (SEQID NO: 2921)
Pro Gly Thr Cys Xaa' Gly Glu Ile Cys Ala Tyr Ala Ala Cys Xaa' Thr Gly Xaa' Xaa' Cys       (SEQID NO: 2922)
Pro Gly Thr Cys Xaa' Gly Glu Ile Cys Ala Tyr Ala Ala Cys Xaa' Thr Gly Xaa' Cys Xaa'       (SEQID NO: 2923)
Pro Gly Thr Cys Xaa' Gly Glu Ile Cys Ala Tyr Ala Ala Cys Xaa' Thr Gly Cys Xaa' Xaa'       (SEQID NO: 2924)
Pro Gly Thr Cys Xaa' Gly Glu Ile Cys Ala Tyr Ala Ala Cys Thr Xaa' Xaa' Gly Cys             (SEQID NO: 2925)
Pro Gly Thr Cys Xaa' Gly Glu Ile Cys Ala Tyr Ala Ala Cys Thr Xaa' Xaa' Xaa' Gly Cys       (SEQID NO: 2926)
Pro Gly Thr Cys Xaa' Gly Glu Ile Cys Ala Tyr Ala Ala Cys Thr Xaa' Xaa' Gly Xaa' Cys       (SEQID NO: 2927)
Pro Gly Thr Cys Xaa' Gly Glu Ile Cys Ala Tyr Ala Ala Cys Thr Xaa' Xaa' Xaa' Gly Cys       (SEQID NO: 2928)
```

FIG. 2

| | | | | | | | | | | | | |
|---|---|---|---|---|---|---|---|---|---|---|---|---|
| Pro | Gly | Thr | Cys | Xaa' | Gly | Ile | Cys | Ala | Tyr | Ala | Ala | Cys | Thr | Xaa' | Xaa' | Gly | Xaa' | Cys | (SEQ ID NO: 2929) |
| Pro | Gly | Thr | Cys | Xaa' | Gly | Ile | Cys | Ala | Tyr | Ala | Ala | Cys | Thr | Xaa' | Gly | Cys | Xaa' | | (SEQ ID NO: 2930) |
| Pro | Gly | Thr | Cys | Xaa' | Gly | Ile | Cys | Ala | Tyr | Ala | Ala | Cys | Thr | Xaa' | Gly | Xaa' | Cys | | (SEQ ID NO: 2931) |
| Pro | Gly | Thr | Cys | Xaa' | Gly | Ile | Cys | Ala | Tyr | Ala | Ala | Cys | Thr | Xaa' | Gly | Xaa' | Xaa' | Cys | (SEQ ID NO: 2932) |
| Pro | Gly | Thr | Cys | Xaa' | Gly | Ile | Cys | Ala | Tyr | Ala | Ala | Cys | Thr | Xaa' | Gly | Xaa' | Cys | Xaa' | (SEQ ID NO: 2933) |
| Pro | Gly | Thr | Cys | Xaa' | Gly | Ile | Cys | Ala | Tyr | Ala | Ala | Cys | Thr | Xaa' | Gly | Cys | Xaa' | | (SEQ ID NO: 2934) |
| Pro | Gly | Thr | Cys | Xaa' | Gly | Ile | Cys | Ala | Tyr | Ala | Ala | Cys | Thr | Xaa' | Gly | Cys | Xaa' | | (SEQ ID NO: 2935) |
| Pro | Gly | Thr | Cys | Xaa' | Gly | Ile | Cys | Ala | Tyr | Ala | Ala | Cys | Thr | Xaa' | Gly | Xaa' | Xaa' | | (SEQ ID NO: 2936) |
| Pro | Gly | Thr | Cys | Xaa' | Gly | Ile | Cys | Ala | Tyr | Ala | Ala | Cys | Thr | Gly | Xaa' | Cys | | | (SEQ ID NO: 2937) |
| Pro | Gly | Thr | Cys | Xaa' | Gly | Ile | Cys | Ala | Tyr | Ala | Ala | Cys | Thr | Gly | Xaa' | Xaa' | Cys | | (SEQ ID NO: 2938) |
| Pro | Gly | Thr | Cys | Xaa' | Gly | Ile | Cys | Ala | Tyr | Ala | Ala | Cys | Thr | Gly | Xaa' | Xaa' | Cys | Xaa' | (SEQ ID NO: 2939) |
| Pro | Gly | Thr | Cys | Xaa' | Gly | Ile | Cys | Ala | Tyr | Ala | Ala | Cys | Thr | Gly | Xaa' | Cys | Xaa' | | (SEQ ID NO: 2940) |
| Pro | Gly | Thr | Cys | Xaa' | Gly | Ile | Cys | Ala | Tyr | Ala | Ala | Cys | Thr | Gly | Xaa' | Cys | Xaa' | | (SEQ ID NO: 2941) |
| Pro | Gly | Thr | Cys | Xaa' | Gly | Ile | Cys | Ala | Tyr | Ala | Ala | Cys | Thr | Gly | Xaa' | Xaa' | Cys | Xaa' | (SEQ ID NO: 2942) |
| Pro | Gly | Thr | Cys | Xaa' | Gly | Ile | Cys | Ala | Tyr | Ala | Ala | Cys | Thr | Gly | Cys | Xaa' | Xaa' | | (SEQ ID NO: 2943) |
| Pro | Gly | Thr | Cys | Xaa' | Gly | Ile | Cys | Ala | Tyr | Ala | Ala | Cys | Thr | Gly | Cys | Xaa' | Xaa' | | (SEQ ID NO: 2944) |
| Pro | Gly | Thr | Cys | Gly | Xaa' | Ile | Cys | Ala | Tyr | Ala | Ala | Cys | Thr | Gly | Cys | | | | (SEQ ID NO: 2945) |
| Pro | Gly | Thr | Cys | Gly | Xaa' | Xaa' | Ile | Cys | Ala | Tyr | Ala | Ala | Cys | Thr | Gly | Cys | | | (SEQ ID NO: 2946) |
| Pro | Gly | Thr | Cys | Gly | Xaa' | Xaa' | Xaa' | Ile | Cys | Ala | Tyr | Ala | Ala | Cys | Thr | Gly | Cys | | (SEQ ID NO: 2947) |
| Pro | Gly | Thr | Cys | Gly | Xaa' | Xaa' | Xaa' | Glu | Ile | Cys | Ala | Tyr | Ala | Ala | Cys | Thr | Gly | Cys | (SEQ ID NO: 2948) |
| Pro | Gly | Thr | Cys | Gly | Xaa' | Xaa' | Xaa' | Glu | Ile | Cys | Ala | Tyr | Ala | Ala | Cys | Thr | Gly | Cys | (SEQ ID NO: 2949) |
| Pro | Gly | Thr | Cys | Gly | Xaa' | Xaa' | Glu | Ile | Cys | Ala | Tyr | Ala | Ala | Cys | Thr | Gly | Cys | | (SEQ ID NO: 2950) |
| Pro | Gly | Thr | Cys | Gly | Xaa' | Xaa' | Glu | Ile | Cys | Xaa' | Ala | Tyr | Ala | Ala | Cys | Thr | Gly | Cys | (SEQ ID NO: 2951) |
| Pro | Gly | Thr | Cys | Gly | Xaa' | Xaa' | Glu | Ile | Cys | Xaa' | Ala | Xaa' | Tyr | Ala | Ala | Cys | Thr | Gly | Cys | (SEQ ID NO: 2952) |
| Pro | Gly | Thr | Cys | Gly | Xaa' | Xaa' | Glu | Ile | Cys | Ala | Tyr | Ala | Ala | Cys | Thr | Gly | Cys | | (SEQ ID NO: 2953) |
| Pro | Gly | Thr | Cys | Gly | Xaa' | Xaa' | Glu | Ile | Cys | Ala | Tyr | Xaa' | Ala | Ala | Cys | Thr | Gly | Cys | (SEQ ID NO: 2954) |
| Pro | Gly | Thr | Cys | Gly | Xaa' | Xaa' | Glu | Ile | Cys | Ala | Tyr | Ala | Ala | Xaa' | Cys | Thr | Gly | Cys | (SEQ ID NO: 2955) |
| Pro | Gly | Thr | Cys | Gly | Xaa' | Xaa' | Glu | Ile | Cys | Ala | Tyr | Ala | Ala | Cys | Thr | Xaa' | Gly | Cys | (SEQ ID NO: 2956) |
| Pro | Gly | Thr | Cys | Gly | Xaa' | Glu | Ile | Cys | Ala | Tyr | Ala | Ala | Cys | Thr | Xaa' | Gly | Cys | | (SEQ ID NO: 2957) |
| Pro | Gly | Thr | Cys | Gly | Xaa' | Glu | Ile | Cys | Xaa' | Ala | Tyr | Ala | Ala | Cys | Thr | Gly | Xaa' | Cys | (SEQ ID NO: 2958) |
| Pro | Gly | Thr | Cys | Gly | Xaa' | Glu | Ile | Cys | Xaa' | Ala | Tyr | Ala | Ala | Cys | Thr | Gly | Cys | Xaa' | (SEQ ID NO: 2959) |
| Pro | Gly | Thr | Cys | Gly | Xaa' | Glu | Ile | Cys | Ala | Tyr | Ala | Ala | Cys | Thr | Gly | Cys | | | (SEQ ID NO: 2960) |
| Pro | Gly | Thr | Cys | Gly | Xaa' | Glu | Ile | Cys | Xaa' | Ile | Cys | Ala | Tyr | Ala | Ala | Cys | Thr | Gly | Cys | (SEQ ID NO: 2961) |
| Pro | Gly | Thr | Cys | Gly | Xaa' | Xaa' | Ile | Cys | Xaa' | Ile | Cys | Ala | Tyr | Ala | Ala | Cys | Thr | Gly | Cys | (SEQ ID NO: 2962) |

FIG. 2

| | | | | | | | | | | |
|---|---|---|---|---|---|---|---|---|---|---|
|Pro Gly Thr Cys Gly Xaa' Xaa' Glu Xaa' Ile Cys Xaa' Ala Tyr Ala Ala Cys Thr Gly Cys|(SEQ ID NO: 2963)|
|Pro Gly Thr Cys Gly Xaa' Xaa' Glu Xaa' Ile Cys Xaa' Ala Tyr Xaa' Ala Ala Cys Thr Gly Cys|(SEQ ID NO: 2964)|
|Pro Gly Thr Cys Gly Xaa' Xaa' Glu Xaa' Ile Cys Xaa' Ala Tyr Ala Ala Cys Thr Gly Cys|(SEQ ID NO: 2965)|
|Pro Gly Thr Cys Gly Xaa' Xaa' Glu Xaa' Ile Cys Xaa' Ala Tyr Ala Xaa' Ala Cys Thr Gly Cys|(SEQ ID NO: 2966)|
|Pro Gly Thr Cys Gly Xaa' Xaa' Glu Xaa' Ile Cys Xaa' Ala Tyr Ala Ala Cys Thr Gly Cys|(SEQ ID NO: 2967)|
|Pro Gly Thr Cys Gly Xaa' Xaa' Glu Xaa' Ile Cys Xaa' Ala Tyr Ala Ala Xaa' Cys Thr Gly Cys|(SEQ ID NO: 2968)|
|Pro Gly Thr Cys Gly Xaa' Xaa' Glu Xaa' Ile Cys Xaa' Ala Tyr Ala Ala Cys Thr Gly Cys|(SEQ ID NO: 2969)|
|Pro Gly Thr Cys Gly Xaa' Xaa' Glu Xaa' Ile Cys Xaa' Ala Tyr Ala Ala Cys Thr Xaa' Gly Cys|(SEQ ID NO: 2970)|
|Pro Gly Thr Cys Gly Xaa' Xaa' Glu Xaa' Ile Cys Xaa' Ala Tyr Ala Ala Cys Thr Gly Xaa' Cys|(SEQ ID NO: 2971)|
|Pro Gly Thr Cys Gly Xaa' Xaa' Glu Xaa' Ile Cys Xaa' Ala Tyr Ala Ala Cys Thr Gly Cys Xaa'|(SEQ ID NO: 2972)|
|Pro Gly Thr Cys Gly Xaa' Xaa' Glu Ile Xaa' Cys Ala Tyr Ala Ala Cys Thr Gly Cys|(SEQ ID NO: 2973)|
|Pro Gly Thr Cys Gly Xaa' Xaa' Glu Ile Xaa' Cys Xaa' Ala Tyr Ala Ala Cys Thr Gly Cys|(SEQ ID NO: 2974)|
|Pro Gly Thr Cys Gly Xaa' Xaa' Glu Ile Cys Xaa' Ala Tyr Ala Ala Cys Thr Gly Cys|(SEQ ID NO: 2975)|
|Pro Gly Thr Cys Gly Xaa' Xaa' Glu Ile Cys Xaa' Xaa' Ala Tyr Ala Ala Cys Thr Gly Cys|(SEQ ID NO: 2976)|
|Pro Gly Thr Cys Gly Xaa' Xaa' Glu Ile Cys Xaa' Ala Xaa' Tyr Ala Ala Cys Thr Gly Cys|(SEQ ID NO: 2977)|
|Pro Gly Thr Cys Gly Xaa' Xaa' Glu Ile Cys Xaa' Ala Tyr Xaa' Ala Ala Cys Thr Gly Cys|(SEQ ID NO: 2978)|
|Pro Gly Thr Cys Gly Xaa' Xaa' Glu Ile Cys Xaa' Ala Tyr Ala Xaa' Ala Cys Thr Gly Cys|(SEQ ID NO: 2979)|
|Pro Gly Thr Cys Gly Xaa' Xaa' Glu Ile Cys Xaa' Ala Tyr Ala Ala Xaa' Cys Thr Gly Cys|(SEQ ID NO: 2980)|
|Pro Gly Thr Cys Gly Xaa' Xaa' Glu Ile Cys Xaa' Ala Tyr Ala Ala Cys Xaa' Thr Gly Cys|(SEQ ID NO: 2981)|
|Pro Gly Thr Cys Gly Xaa' Xaa' Glu Ile Cys Xaa' Ala Tyr Ala Ala Cys Thr Xaa' Gly Cys|(SEQ ID NO: 2982)|
|Pro Gly Thr Cys Gly Xaa' Xaa' Glu Ile Cys Xaa' Ala Tyr Ala Ala Cys Thr Gly Cys Xaa'|(SEQ ID NO: 2983)|
|Pro Gly Thr Cys Gly Xaa' Xaa' Glu Ile Cys Ala Xaa' Tyr Ala Ala Cys Thr Gly Cys|(SEQ ID NO: 2984)|
|Pro Gly Thr Cys Gly Xaa' Xaa' Glu Ile Cys Xaa' Ala Xaa' Tyr Ala Ala Cys Thr Gly Cys|(SEQ ID NO: 2985)|
|Pro Gly Thr Cys Gly Xaa' Xaa' Glu Ile Cys Ala Xaa' Tyr Ala Ala Cys Thr Gly Cys|(SEQ ID NO: 2986)|
|Pro Gly Thr Cys Gly Xaa' Xaa' Glu Ile Cys Ala Xaa' Tyr Xaa' Ala Ala Cys Thr Gly Cys|(SEQ ID NO: 2987)|
|Pro Gly Thr Cys Gly Xaa' Xaa' Glu Ile Cys Ala Xaa' Tyr Ala Xaa' Ala Cys Thr Gly Cys|(SEQ ID NO: 2988)|
|Pro Gly Thr Cys Gly Xaa' Xaa' Glu Ile Cys Ala Xaa' Tyr Ala Ala Xaa' Cys Thr Gly Cys|(SEQ ID NO: 2989)|
|Pro Gly Thr Cys Gly Xaa' Xaa' Glu Ile Cys Ala Xaa' Tyr Ala Ala Cys Xaa' Thr Gly Cys|(SEQ ID NO: 2990)|
|Pro Gly Thr Cys Gly Xaa' Xaa' Glu Ile Cys Ala Xaa' Tyr Ala Ala Cys Thr Xaa' Gly Cys|(SEQ ID NO: 2991)|
|Pro Gly Thr Cys Gly Xaa' Xaa' Glu Ile Cys Ala Xaa' Tyr Ala Ala Cys Thr Gly Xaa' Cys|(SEQ ID NO: 2992)|
|Pro Gly Thr Cys Gly Xaa' Xaa' Glu Ile Cys Ala Xaa' Tyr Ala Ala Cys Thr Gly Cys Xaa'|(SEQ ID NO: 2993)|
|Pro Gly Thr Cys Gly Xaa' Xaa' Glu Ile Cys Ala Xaa' Xaa' Tyr Ala Ala Cys Thr Gly Cys|(SEQ ID NO: 2994)|
|Pro Gly Thr Cys Gly Xaa' Xaa' Glu Ile Cys Ala Xaa' Tyr Xaa' Ala Ala Cys Thr Gly Cys|(SEQ ID NO: 2995)|
|Pro Gly Thr Cys Gly Xaa' Xaa' Glu Ile Cys Ala Xaa' Tyr Ala Xaa' Ala Cys Thr Gly Cys|(SEQ ID NO: 2996)|

FIG. 2

| | | | | | | | | | | | | | |
|---|---|---|---|---|---|---|---|---|---|---|---|---|---|
| Pro Gly Thr Cys Gly Xaa' Xaa' Glu Ile Cys Ala Xaa' Tyr Ala Ala Xaa' Cys Thr Gly Cys | (SEQ ID NO: 2997) |
| Pro Gly Thr Cys Gly Xaa' Xaa' Glu Ile Cys Ala Xaa' Tyr Ala Ala Xaa' Cys Xaa' Gly Cys | (SEQ ID NO: 2998) |
| Pro Gly Thr Cys Gly Xaa' Xaa' Glu Ile Cys Ala Xaa' Tyr Ala Ala Xaa' Cys Thr Xaa' Cys | (SEQ ID NO: 2999) |
| Pro Gly Thr Cys Gly Xaa' Xaa' Glu Ile Cys Ala Xaa' Tyr Ala Ala Xaa' Cys Thr Gly Xaa' | (SEQ ID NO: 3000) |
| Pro Gly Thr Cys Gly Xaa' Xaa' Glu Ile Cys Ala Xaa' Tyr Ala Ala Ala Cys Thr Gly Cys | (SEQ ID NO: 3001) |
| Pro Gly Thr Cys Gly Xaa' Xaa' Glu Ile Cys Ala Xaa' Tyr Xaa' Ala Ala Cys Thr Gly Cys | (SEQ ID NO: 3002) |
| Pro Gly Thr Cys Gly Xaa' Xaa' Glu Ile Cys Ala Xaa' Xaa' Ala Ala Ala Cys Thr Gly Cys | (SEQ ID NO: 3003) |
| Pro Gly Thr Cys Gly Xaa' Xaa' Glu Ile Cys Ala Tyr Xaa' Ala Ala Cys Thr Gly Cys | (SEQ ID NO: 3004) |
| Pro Gly Thr Cys Gly Xaa' Xaa' Glu Ile Cys Ala Xaa' Tyr Xaa' Ala Cys Thr Gly Cys | (SEQ ID NO: 3005) |
| Pro Gly Thr Cys Gly Xaa' Xaa' Glu Ile Cys Ala Xaa' Tyr Ala Xaa' Cys Xaa' Gly Cys | (SEQ ID NO: 3006) |
| Pro Gly Thr Cys Gly Xaa' Xaa' Glu Ile Cys Ala Xaa' Tyr Ala Ala Xaa' Cys Thr Gly Xaa' | (SEQ ID NO: 3007) |
| Pro Gly Thr Cys Gly Xaa' Xaa' Glu Ile Cys Ala Xaa' Tyr Ala Ala Ala Cys Thr Gly Cys | (SEQ ID NO: 3008) |
| Pro Gly Thr Cys Gly Xaa' Xaa' Glu Ile Cys Ala Xaa' Tyr Ala Ala Xaa' Cys Thr Gly Xaa' | (SEQ ID NO: 3009) |
| Pro Gly Thr Cys Gly Xaa' Xaa' Glu Ile Cys Ala Xaa' Tyr Ala Xaa' Ala Cys Thr Gly Cys | (SEQ ID NO: 3010) |
| Pro Gly Thr Cys Gly Xaa' Xaa' Glu Ile Cys Ala Xaa' Tyr Ala Xaa' Ala Cys Thr Gly Cys | (SEQ ID NO: 3011) |
| Pro Gly Thr Cys Gly Xaa' Xaa' Glu Ile Cys Ala Xaa' Tyr Ala Xaa' Xaa' Cys Thr Gly Cys | (SEQ ID NO: 3012) |
| Pro Gly Thr Cys Gly Xaa' Xaa' Glu Ile Cys Ala Xaa' Tyr Ala Xaa' Xaa' Cys Thr Gly Cys | (SEQ ID NO: 3013) |
| Pro Gly Thr Cys Gly Xaa' Xaa' Glu Ile Cys Ala Xaa' Tyr Ala Xaa' Xaa' Cys Thr Gly Cys | (SEQ ID NO: 3014) |
| Pro Gly Thr Cys Gly Xaa' Xaa' Glu Ile Cys Ala Xaa' Tyr Ala Xaa' Ala Cys Thr Gly Xaa' | (SEQ ID NO: 3015) |
| Pro Gly Thr Cys Gly Xaa' Xaa' Glu Ile Cys Ala Xaa' Tyr Ala Ala Xaa' Cys Thr Gly Cys | (SEQ ID NO: 3016) |
| Pro Gly Thr Cys Gly Xaa' Xaa' Glu Ile Cys Ala Xaa' Tyr Ala Ala Xaa' Cys Thr Gly Cys | (SEQ ID NO: 3017) |
| Pro Gly Thr Cys Gly Xaa' Xaa' Glu Ile Cys Ala Xaa' Tyr Ala Ala Xaa' Cys Xaa' Gly Cys | (SEQ ID NO: 3018) |
| Pro Gly Thr Cys Gly Xaa' Xaa' Glu Ile Cys Ala Xaa' Tyr Ala Ala Xaa' Cys Thr Gly Cys | (SEQ ID NO: 3019) |
| Pro Gly Thr Cys Gly Xaa' Xaa' Glu Ile Cys Ala Xaa' Tyr Ala Ala Xaa' Cys Thr Gly Cys | (SEQ ID NO: 3020) |
| Pro Gly Thr Cys Gly Xaa' Xaa' Glu Ile Cys Ala Xaa' Tyr Ala Ala Xaa' Cys Thr Gly Xaa' | (SEQ ID NO: 3021) |
| Pro Gly Thr Cys Gly Xaa' Xaa' Glu Ile Cys Ala Xaa' Tyr Ala Ala Cys Xaa' Thr Gly Cys | (SEQ ID NO: 3022) |
| Pro Gly Thr Cys Gly Xaa' Xaa' Glu Ile Cys Ala Xaa' Tyr Ala Ala Cys Xaa' Gly Cys | (SEQ ID NO: 3023) |
| Pro Gly Thr Cys Gly Xaa' Xaa' Glu Ile Cys Ala Xaa' Tyr Ala Ala Ala Cys Xaa' Thr Gly Cys | (SEQ ID NO: 3024) |
| Pro Gly Thr Cys Gly Xaa' Xaa' Glu Ile Cys Ala Xaa' Tyr Ala Ala Cys Thr Xaa' Gly Cys | (SEQ ID NO: 3025) |
| Pro Gly Thr Cys Gly Xaa' Xaa' Glu Ile Cys Ala Xaa' Tyr Ala Ala Cys Thr Gly Xaa' Cys | (SEQ ID NO: 3026) |
| Pro Gly Thr Cys Gly Xaa' Xaa' Glu Ile Cys Ala Xaa' Tyr Ala Ala Cys Thr Xaa' Gly Xaa' | (SEQ ID NO: 3027) |
| Pro Gly Thr Cys Gly Xaa' Xaa' Glu Ile Cys Ala Xaa' Tyr Ala Ala Ala Cys Thr Gly Cys | (SEQ ID NO: 3028) |
| Pro Gly Thr Cys Gly Xaa' Xaa' Glu Ile Cys Ala Tyr Ala Ala Cys Thr Xaa' Gly Cys | (SEQ ID NO: 3029) |
| Pro Gly Thr Cys Gly Xaa' Xaa' Glu Ile Cys Ala Tyr Ala Ala Cys Thr Ala Gly Xaa' Cys | (SEQ ID NO: 3030) |

FIG. 2

| | | | | | | | | | | | | | | | | |
|---|---|---|---|---|---|---|---|---|---|---|---|---|---|---|---|---|
| Pro Gly Thr Cys Gly Xaa' Xaa' Glu Ile Cys Ala Tyr Ala Ala Cys Thr Xaa' Gly Cys Xaa' | (SEQ ID NO: 3031) |
| Pro Gly Thr Cys Gly Xaa' Xaa' Glu Ile Cys Ala Tyr Ala Ala Cys Thr Gly Xaa' Cys | (SEQ ID NO: 3032) |
| Pro Gly Thr Cys Gly Xaa' Xaa' Glu Ile Cys Ala Tyr Ala Ala Cys Thr Gly Xaa' Xaa' Cys | (SEQ ID NO: 3033) |
| Pro Gly Thr Cys Gly Xaa' Xaa' Glu Ile Cys Ala Tyr Ala Ala Cys Thr Gly Xaa' Cys Xaa' | (SEQ ID NO: 3034) |
| Pro Gly Thr Cys Gly Xaa' Xaa' Glu Ile Cys Ala Tyr Ala Ala Cys Thr Gly Cys Xaa' | (SEQ ID NO: 3035) |
| Pro Gly Thr Cys Gly Xaa' Xaa' Glu Ile Cys Ala Tyr Ala Ala Cys Thr Gly Cys Xaa' Xaa' | (SEQ ID NO: 3036) |
| Pro Gly Thr Cys Gly Xaa' Xaa' Glu Xaa' Ile Cys Ala Tyr Ala Ala Cys Thr Gly Cys | (SEQ ID NO: 3037) |
| Pro Gly Thr Cys Gly Xaa' Xaa' Glu Xaa' Ile Cys Ala Tyr Ala Ala Cys Thr Gly Cys | (SEQ ID NO: 3038) |
| Pro Gly Thr Cys Gly Xaa' Xaa' Glu Xaa' Xaa' Ile Cys Ala Tyr Ala Ala Cys Thr Gly Cys | (SEQ ID NO: 3039) |
| Pro Gly Thr Cys Gly Xaa' Xaa' Glu Xaa' Xaa' Ile Xaa' Cys Ala Tyr Ala Ala Cys Thr Gly Cys | (SEQ ID NO: 3040) |
| Pro Gly Thr Cys Gly Xaa' Xaa' Glu Xaa' Xaa' Ile Xaa' Cys Ala Tyr Ala Ala Cys Thr Gly Cys | (SEQ ID NO: 3041) |
| Pro Gly Thr Cys Gly Xaa' Xaa' Glu Xaa' Xaa' Ile Xaa' Cys Xaa' Ala Tyr Ala Ala Cys Thr Gly Cys | (SEQ ID NO: 3042) |
| Pro Gly Thr Cys Gly Xaa' Xaa' Glu Xaa' Xaa' Ile Xaa' Cys Ala Xaa' Tyr Ala Ala Cys Thr Gly Cys | (SEQ ID NO: 3043) |
| Pro Gly Thr Cys Gly Xaa' Xaa' Glu Xaa' Xaa' Ile Xaa' Cys Ala Tyr Xaa' Ala Ala Cys Thr Gly Cys | (SEQ ID NO: 3044) |
| Pro Gly Thr Cys Gly Xaa' Xaa' Glu Xaa' Xaa' Ile Xaa' Cys Ala Tyr Ala Xaa' Ala Cys Thr Gly Cys | (SEQ ID NO: 3045) |
| Pro Gly Thr Cys Gly Xaa' Xaa' Glu Xaa' Xaa' Ile Xaa' Cys Ala Tyr Ala Ala Xaa' Cys Thr Gly Cys | (SEQ ID NO: 3046) |
| Pro Gly Thr Cys Gly Xaa' Xaa' Glu Xaa' Xaa' Ile Xaa' Cys Ala Tyr Ala Ala Cys Xaa' Thr Gly Cys | (SEQ ID NO: 3047) |
| Pro Gly Thr Cys Gly Xaa' Xaa' Glu Xaa' Xaa' Ile Xaa' Cys Ala Tyr Ala Ala Cys Thr Xaa' Gly Cys Xaa' | (SEQ ID NO: 3048) |
| Pro Gly Thr Cys Gly Xaa' Xaa' Glu Xaa' Xaa' Ile Xaa' Cys Ala Tyr Ala Ala Cys Thr Gly Cys | (SEQ ID NO: 3049) |
| Pro Gly Thr Cys Gly Xaa' Xaa' Glu Xaa' Xaa' Ile Xaa' Cys Ala Tyr Ala Ala Cys Thr Gly Cys | (SEQ ID NO: 3050) |
| Pro Gly Thr Cys Gly Xaa' Xaa' Glu Xaa' Xaa' Ile Xaa' Cys Xaa' Ala Tyr Ala Ala Cys Thr Gly Cys | (SEQ ID NO: 3051) |
| Pro Gly Thr Cys Gly Xaa' Xaa' Glu Xaa' Xaa' Ile Xaa' Cys Xaa' Ala Tyr Ala Ala Cys Thr Gly Cys | (SEQ ID NO: 3052) |
| Pro Gly Thr Cys Gly Xaa' Xaa' Glu Xaa' Xaa' Ile Xaa' Cys Ala Xaa' Tyr Ala Ala Cys Thr Gly Cys | (SEQ ID NO: 3053) |
| Pro Gly Thr Cys Gly Xaa' Xaa' Glu Xaa' Xaa' Ile Xaa' Cys Ala Tyr Xaa' Ala Ala Cys Thr Gly Cys | (SEQ ID NO: 3054) |
| Pro Gly Thr Cys Gly Xaa' Xaa' Glu Xaa' Xaa' Ile Xaa' Cys Ala Tyr Ala Xaa' Ala Cys Thr Gly Cys | (SEQ ID NO: 3055) |
| Pro Gly Thr Cys Gly Xaa' Xaa' Glu Xaa' Xaa' Ile Xaa' Cys Ala Tyr Ala Ala Xaa' Cys Thr Gly Cys | (SEQ ID NO: 3056) |
| Pro Gly Thr Cys Gly Xaa' Xaa' Glu Xaa' Xaa' Ile Xaa' Cys Ala Tyr Ala Ala Cys Xaa' Thr Gly Cys | (SEQ ID NO: 3057) |
| Pro Gly Thr Cys Gly Xaa' Xaa' Glu Xaa' Xaa' Ile Xaa' Cys Ala Tyr Ala Ala Cys Thr Xaa' Gly Cys | (SEQ ID NO: 3058) |
| Pro Gly Thr Cys Gly Xaa' Xaa' Glu Xaa' Xaa' Ile Cys Xaa' Ala Tyr Ala Ala Cys Thr Gly Xaa' Cys | (SEQ ID NO: 3059) |
| Pro Gly Thr Cys Gly Xaa' Xaa' Glu Xaa' Xaa' Ile Cys Xaa' Ala Tyr Ala Ala Cys Thr Gly Xaa' Xaa' Cys | (SEQ ID NO: 3060) |
| Pro Gly Thr Cys Gly Xaa' Xaa' Glu Xaa' Xaa' Ile Cys Xaa' Ala Tyr Ala Ala Cys Thr Gly Cys Xaa' | (SEQ ID NO: 3061) |
| Pro Gly Thr Cys Gly Xaa' Xaa' Glu Xaa' Xaa' Ile Cys Xaa' Xaa' Ala Tyr Ala Ala Cys Thr Gly Cys | (SEQ ID NO: 3062) |

| | | | | | | | | | | | |
|---|---|---|---|---|---|---|---|---|---|---|---|
| Pro | Gly | Thr | Cys | Gly | Glu | Xaa' | Ile | Cys | Xaa' | Ala | Tyr | Ala | Xaa' | Ala | Cys | Thr | Gly | Cys | (SEQ ID NO: 3065) |
| Pro | Gly | Thr | Cys | Gly | Glu | Xaa' | Ile | Cys | Xaa' | Ala | Tyr | Ala | Ala | Xaa' | Cys | Thr | Gly | Cys | (SEQ ID NO: 3066) |
| Pro | Gly | Thr | Cys | Gly | Glu | Xaa' | Ile | Cys | Xaa' | Ala | Tyr | Ala | Ala | Cys | Xaa' | Thr | Gly | Cys | (SEQ ID NO: 3067) |
| Pro | Gly | Thr | Cys | Gly | Glu | Xaa' | Ile | Cys | Xaa' | Ala | Tyr | Ala | Ala | Cys | Thr | Xaa' | Gly | Cys | (SEQ ID NO: 3068) |
| Pro | Gly | Thr | Cys | Gly | Glu | Xaa' | Ile | Cys | Xaa' | Ala | Tyr | Ala | Ala | Cys | Thr | Gly | Xaa' | Cys | (SEQ ID NO: 3069) |
| Pro | Gly | Thr | Cys | Gly | Glu | Xaa' | Ile | Cys | Xaa' | Ala | Tyr | Ala | Ala | Cys | Thr | Gly | Cys | Xaa' | (SEQ ID NO: 3070) |
| Pro | Gly | Thr | Cys | Gly | Glu | Xaa' | Ile | Cys | Ala | Xaa' | Xaa' | Ala | Ala | Cys | Thr | Gly | Cys | (SEQ ID NO: 3071) |
| Pro | Gly | Thr | Cys | Gly | Glu | Xaa' | Ile | Cys | Ala | Xaa' | Tyr | Ala | Ala | Cys | Thr | Gly | Cys | (SEQ ID NO: 3072) |
| Pro | Gly | Thr | Cys | Gly | Glu | Xaa' | Ile | Cys | Ala | Xaa' | Tyr | Xaa' | Ala | Ala | Cys | Thr | Gly | Cys | (SEQ ID NO: 3073) |
| Pro | Gly | Thr | Cys | Gly | Glu | Xaa' | Ile | Cys | Ala | Xaa' | Tyr | Ala | Xaa' | Ala | Cys | Thr | Gly | Cys | (SEQ ID NO: 3074) |
| Pro | Gly | Thr | Cys | Gly | Glu | Xaa' | Ile | Cys | Ala | Xaa' | Tyr | Ala | Ala | Xaa' | Cys | Thr | Gly | Cys | (SEQ ID NO: 3075) |
| Pro | Gly | Thr | Cys | Gly | Glu | Xaa' | Ile | Cys | Ala | Xaa' | Tyr | Ala | Ala | Cys | Xaa' | Thr | Gly | Cys | (SEQ ID NO: 3076) |
| Pro | Gly | Thr | Cys | Gly | Glu | Xaa' | Ile | Cys | Ala | Xaa' | Tyr | Ala | Ala | Cys | Thr | Xaa' | Gly | Cys | (SEQ ID NO: 3077) |
| Pro | Gly | Thr | Cys | Gly | Glu | Xaa' | Ile | Cys | Ala | Xaa' | Tyr | Ala | Ala | Cys | Thr | Gly | Xaa' | Cys | (SEQ ID NO: 3078) |
| Pro | Gly | Thr | Cys | Gly | Glu | Xaa' | Ile | Cys | Ala | Xaa' | Tyr | Ala | Ala | Cys | Thr | Gly | Cys | Xaa' | (SEQ ID NO: 3079) |
| Pro | Gly | Thr | Cys | Gly | Glu | Xaa' | Ile | Cys | Ala | Tyr | Xaa' | Xaa' | Ala | Ala | Cys | Thr | Gly | Cys | (SEQ ID NO: 3080) |
| Pro | Gly | Thr | Cys | Gly | Glu | Xaa' | Ile | Cys | Ala | Tyr | Xaa' | Ala | Xaa' | Ala | Cys | Thr | Gly | Cys | (SEQ ID NO: 3081) |
| Pro | Gly | Thr | Cys | Gly | Glu | Xaa' | Ile | Cys | Ala | Tyr | Xaa' | Ala | Ala | Xaa' | Cys | Thr | Gly | Cys | (SEQ ID NO: 3082) |
| Pro | Gly | Thr | Cys | Gly | Glu | Xaa' | Ile | Cys | Ala | Tyr | Xaa' | Ala | Ala | Cys | Xaa' | Thr | Gly | Cys | (SEQ ID NO: 3083) |
| Pro | Gly | Thr | Cys | Gly | Glu | Xaa' | Ile | Cys | Ala | Tyr | Xaa' | Ala | Ala | Cys | Thr | Xaa' | Gly | Cys | (SEQ ID NO: 3084) |
| Pro | Gly | Thr | Cys | Gly | Glu | Xaa' | Ile | Cys | Ala | Tyr | Xaa' | Ala | Ala | Cys | Thr | Gly | Xaa' | Cys | (SEQ ID NO: 3085) |
| Pro | Gly | Thr | Cys | Gly | Glu | Xaa' | Ile | Cys | Ala | Tyr | Xaa' | Ala | Ala | Cys | Thr | Gly | Cys | Xaa' | (SEQ ID NO: 3086) |
| Pro | Gly | Thr | Cys | Gly | Glu | Xaa' | Ile | Cys | Ala | Tyr | Ala | Xaa' | Xaa' | Ala | Cys | Thr | Gly | Cys | (SEQ ID NO: 3087) |
| Pro | Gly | Thr | Cys | Gly | Glu | Xaa' | Ile | Cys | Ala | Tyr | Ala | Xaa' | Ala | Xaa' | Cys | Thr | Gly | Cys | (SEQ ID NO: 3088) |
| Pro | Gly | Thr | Cys | Gly | Glu | Xaa' | Ile | Cys | Ala | Tyr | Ala | Xaa' | Ala | Cys | Xaa' | Thr | Gly | Cys | (SEQ ID NO: 3089) |
| Pro | Gly | Thr | Cys | Gly | Glu | Xaa' | Ile | Cys | Ala | Tyr | Ala | Xaa' | Ala | Cys | Thr | Xaa' | Gly | Cys | (SEQ ID NO: 3090) |
| Pro | Gly | Thr | Cys | Gly | Glu | Xaa' | Ile | Cys | Ala | Tyr | Ala | Xaa' | Ala | Cys | Thr | Gly | Xaa' | Cys | (SEQ ID NO: 3091) |
| Pro | Gly | Thr | Cys | Gly | Glu | Xaa' | Ile | Cys | Ala | Tyr | Ala | Xaa' | Ala | Cys | Thr | Gly | Cys | Xaa' | (SEQ ID NO: 3092) |
| Pro | Gly | Thr | Cys | Gly | Glu | Xaa' | Ile | Cys | Ala | Tyr | Ala | Ala | Xaa' | Xaa' | Cys | Thr | Gly | Cys | (SEQ ID NO: 3093) |
| Pro | Gly | Thr | Cys | Gly | Glu | Xaa' | Ile | Cys | Ala | Tyr | Ala | Ala | Xaa' | Cys | Xaa' | Thr | Gly | Cys | (SEQ ID NO: 3094) |
| Pro | Gly | Thr | Cys | Gly | Glu | Xaa' | Ile | Cys | Ala | Tyr | Ala | Ala | Xaa' | Cys | Thr | Xaa' | Gly | Cys | (SEQ ID NO: 3095) |
| Pro | Gly | Thr | Cys | Gly | Glu | Xaa' | Ile | Cys | Ala | Tyr | Ala | Ala | Xaa' | Cys | Thr | Gly | Xaa' | Cys | (SEQ ID NO: 3096) |
| Pro | Gly | Thr | Cys | Gly | Glu | Xaa' | Ile | Cys | Ala | Tyr | Ala | Ala | Xaa' | Cys | Thr | Gly | Cys | Xaa' | (SEQ ID NO: 3097) |
| Pro | Gly | Thr | Cys | Gly | Glu | Xaa' | Ile | Cys | Ala | Tyr | Ala | Ala | Xaa' | Cys | Thr | Gly | Cys | (SEQ ID NO: 3098) |

FIG. 2

| | | | | | | | | | | | | | |
|---|---|---|---|---|---|---|---|---|---|---|---|---|---|
| Pro | Gly | Thr | Cys | Gly | Xaa' | Glu | Xaa' | Ile | Cys | Ala | Tyr | Ala | Ala | Xaa' | Cys | Thr | Gly | Xaa' | Cys | (SEQ ID NO: 3099) |
| Pro | Gly | Thr | Cys | Gly | Xaa' | Glu | Xaa' | Ile | Cys | Ala | Tyr | Ala | Ala | Xaa' | Cys | Thr | Gly | Cys | Xaa' | (SEQ ID NO: 3100) |
| Pro | Gly | Thr | Cys | Gly | Xaa' | Glu | Xaa' | Ile | Cys | Ala | Tyr | Ala | Ala | Xaa' | Cys | Xaa' | Thr | Gly | Cys | (SEQ ID NO: 3101) |
| Pro | Gly | Thr | Cys | Gly | Xaa' | Glu | Xaa' | Ile | Cys | Ala | Tyr | Ala | Ala | Cys | Xaa' | Xaa' | Thr | Gly | Cys | (SEQ ID NO: 3102) |
| Pro | Gly | Thr | Cys | Gly | Xaa' | Glu | Xaa' | Ile | Cys | Ala | Tyr | Ala | Ala | Cys | Xaa' | Thr | Xaa' | Gly | Cys | (SEQ ID NO: 3103) |
| Pro | Gly | Thr | Cys | Gly | Xaa' | Glu | Xaa' | Ile | Cys | Ala | Tyr | Ala | Ala | Cys | Xaa' | Thr | Gly | Xaa' | Cys | (SEQ ID NO: 3104) |
| Pro | Gly | Thr | Cys | Gly | Xaa' | Glu | Xaa' | Ile | Cys | Ala | Tyr | Ala | Ala | Cys | Xaa' | Thr | Gly | Cys | Xaa' | (SEQ ID NO: 3105) |
| Pro | Gly | Thr | Cys | Gly | Xaa' | Glu | Xaa' | Ile | Cys | Ala | Tyr | Ala | Ala | Cys | Thr | Xaa' | Xaa' | Gly | Cys | (SEQ ID NO: 3106) |
| Pro | Gly | Thr | Cys | Gly | Xaa' | Glu | Xaa' | Ile | Cys | Ala | Tyr | Ala | Ala | Cys | Thr | Xaa' | Gly | Xaa' | Cys | (SEQ ID NO: 3107) |
| Pro | Gly | Thr | Cys | Gly | Xaa' | Glu | Xaa' | Ile | Cys | Ala | Tyr | Ala | Ala | Cys | Thr | Xaa' | Gly | Cys | Xaa' | (SEQ ID NO: 3108) |
| Pro | Gly | Thr | Cys | Gly | Xaa' | Glu | Xaa' | Ile | Cys | Ala | Tyr | Ala | Ala | Cys | Thr | Gly | Xaa' | Xaa' | Cys | (SEQ ID NO: 3109) |
| Pro | Gly | Thr | Cys | Gly | Xaa' | Glu | Xaa' | Ile | Cys | Ala | Tyr | Ala | Ala | Cys | Thr | Gly | Xaa' | Cys | Xaa' | (SEQ ID NO: 3110) |
| Pro | Gly | Thr | Cys | Gly | Xaa' | Glu | Xaa' | Ile | Cys | Ala | Tyr | Ala | Ala | Cys | Thr | Gly | Cys | Xaa' | Xaa' | (SEQ ID NO: 3111) |
| Pro | Gly | Thr | Cys | Gly | Xaa' | Glu | Xaa' | Ile | Cys | Ala | Tyr | Ala | Ala | Cys | Thr | Gly | Xaa' | Xaa' | Cys | (SEQ ID NO: 3112) |
| Pro | Gly | Thr | Cys | Gly | Xaa' | Glu | Xaa' | Ile | Cys | Ala | Tyr | Ala | Ala | Cys | Thr | Gly | Xaa' | Cys | Xaa' | (SEQ ID NO: 3113) |
| Pro | Gly | Thr | Cys | Gly | Xaa' | Glu | Xaa' | Ile | Cys | Ala | Tyr | Ala | Ala | Cys | Thr | Gly | Cys | Xaa' | Xaa' | (SEQ ID NO: 3114) |
| Pro | Gly | Thr | Cys | Gly | Xaa' | Glu | Ile | Ile | Xaa' | Ala | Tyr | Ala | Ala | Cys | Thr | Gly | Cys | | | (SEQ ID NO: 3115) |
| Pro | Gly | Thr | Cys | Gly | Xaa' | Glu | Xaa' | Ile | Xaa' | Ala | Tyr | Ala | Cys | Ala | Ala | Cys | Thr | Gly | Cys | (SEQ ID NO: 3116) |
| Pro | Gly | Thr | Cys | Gly | Xaa' | Glu | Xaa' | Ile | Xaa' | Cys | Ala | Tyr | Ala | Ala | Cys | Thr | Ala | Gly | Cys | (SEQ ID NO: 3117) |
| Pro | Gly | Thr | Cys | Gly | Xaa' | Glu | Xaa' | Ile | Xaa' | Cys | Xaa' | Ala | Tyr | Ala | Ala | Cys | Thr | Gly | Cys | (SEQ ID NO: 3118) |
| Pro | Gly | Thr | Cys | Gly | Xaa' | Glu | Xaa' | Ile | Xaa' | Cys | Ala | Xaa' | Tyr | Ala | Ala | Cys | Thr | Gly | Cys | (SEQ ID NO: 3119) |
| Pro | Gly | Thr | Cys | Gly | Xaa' | Glu | Xaa' | Ile | Xaa' | Cys | Ala | Tyr | Xaa' | Ala | Ala | Cys | Thr | Gly | Cys | (SEQ ID NO: 3120) |
| Pro | Gly | Thr | Cys | Gly | Xaa' | Glu | Xaa' | Ile | Xaa' | Cys | Ala | Tyr | Ala | Xaa' | Ala | Cys | Thr | Gly | Cys | (SEQ ID NO: 3121) |
| Pro | Gly | Thr | Cys | Gly | Xaa' | Glu | Xaa' | Ile | Xaa' | Cys | Ala | Tyr | Ala | Ala | Xaa' | Cys | Thr | Gly | Cys | (SEQ ID NO: 3122) |
| Pro | Gly | Thr | Cys | Gly | Xaa' | Glu | Xaa' | Ile | Xaa' | Cys | Ala | Tyr | Ala | Ala | Xaa' | Cys | Thr | Gly | Cys | (SEQ ID NO: 3123) |
| Pro | Gly | Thr | Cys | Gly | Xaa' | Glu | Xaa' | Ile | Xaa' | Cys | Ala | Tyr | Ala | Ala | Cys | Xaa' | Thr | Gly | Cys | (SEQ ID NO: 3124) |
| Pro | Gly | Thr | Cys | Gly | Xaa' | Glu | Xaa' | Ile | Xaa' | Cys | Ala | Tyr | Ala | Ala | Cys | Thr | Xaa' | Gly | Cys | (SEQ ID NO: 3125) |
| Pro | Gly | Thr | Cys | Gly | Xaa' | Glu | Xaa' | Ile | Xaa' | Cys | Ala | Tyr | Ala | Ala | Cys | Thr | Gly | Xaa' | Cys | (SEQ ID NO: 3126) |
| Pro | Gly | Thr | Cys | Gly | Xaa' | Glu | Xaa' | Ile | Xaa' | Cys | Ala | Tyr | Ala | Ala | Cys | Thr | Gly | Cys | Xaa' | (SEQ ID NO: 3127) |
| Pro | Gly | Thr | Cys | Gly | Xaa' | Glu | Xaa' | Ile | Xaa' | Cys | Xaa' | Ala | Tyr | Ala | Ala | Cys | Thr | Gly | Cys | (SEQ ID NO: 3128) |
| Pro | Gly | Thr | Cys | Gly | Xaa' | Glu | Xaa' | Ile | Xaa' | Cys | Xaa' | Ala | Tyr | Ala | Ala | Cys | Thr | Gly | Cys | (SEQ ID NO: 3129) |
| Pro | Gly | Thr | Cys | Gly | Xaa' | Glu | Xaa' | Ile | Xaa' | Cys | Xaa' | Ala | Tyr | Ala | Ala | Cys | Thr | Gly | Cys | (SEQ ID NO: 3130) |
| Pro | Gly | Thr | Cys | Gly | Xaa' | Glu | Xaa' | Ile | Xaa' | Cys | Xaa' | Ala | Tyr | Ala | Ala | Cys | Thr | Gly | Cys | (SEQ ID NO: 3131) |
| Pro | Gly | Thr | Cys | Gly | Xaa' | Glu | Xaa' | Ile | Xaa' | Cys | Xaa' | Ala | Tyr | Ala | Ala | Xaa' | Cys | Thr | Gly | Cys | (SEQ ID NO: 3132) |

FIG. 2

| | | | | | | | | | | | |
|---|---|---|---|---|---|---|---|---|---|---|---|
| Pro Gly Thr Cys Gly Xaa' Glu Ile Xaa' Cys Xaa' Ala Tyr Ala Ala Cys Xaa' Thr Gly Cys | (SEQ ID NO: 3133) |
| Pro Gly Thr Cys Gly Xaa' Glu Ile Xaa' Cys Xaa' Ala Tyr Ala Ala Cys Thr Gly Cys | (SEQ ID NO: 3134) |
| Pro Gly Thr Cys Gly Xaa' Glu Ile Xaa' Cys Xaa' Ala Tyr Ala Ala Cys Thr Gly Xaa' Cys | (SEQ ID NO: 3135) |
| Pro Gly Thr Cys Gly Xaa' Glu Ile Xaa' Cys Xaa' Ala Tyr Ala Ala Cys Thr Gly Cys Xaa' | (SEQ ID NO: 3136) |
| Pro Gly Thr Cys Gly Xaa' Glu Ile Xaa' Cys Ala Xaa' Tyr Ala Ala Cys Thr Gly Cys | (SEQ ID NO: 3137) |
| Pro Gly Thr Cys Gly Xaa' Glu Ile Xaa' Cys Ala Xaa' Tyr Ala Ala Cys Thr Gly Cys | (SEQ ID NO: 3138) |
| Pro Gly Thr Cys Gly Xaa' Glu Ile Xaa' Cys Ala Xaa' Tyr Ala Ala Ala Cys Thr Gly Cys | (SEQ ID NO: 3139) |
| Pro Gly Thr Cys Gly Xaa' Glu Ile Xaa' Cys Ala Xaa' Tyr Ala Ala Cys Thr Gly Cys | (SEQ ID NO: 3140) |
| Pro Gly Thr Cys Gly Xaa' Glu Ile Xaa' Cys Ala Xaa' Tyr Xaa' Ala Ala Cys Thr Gly Cys | (SEQ ID NO: 3141) |
| Pro Gly Thr Cys Gly Xaa' Glu Ile Xaa' Cys Ala Xaa' Tyr Ala Xaa' Ala Cys Thr Gly Cys | (SEQ ID NO: 3142) |
| Pro Gly Thr Cys Gly Xaa' Glu Ile Xaa' Cys Ala Xaa' Tyr Ala Ala Xaa' Cys Thr Gly Cys | (SEQ ID NO: 3143) |
| Pro Gly Thr Cys Gly Xaa' Glu Ile Xaa' Cys Ala Xaa' Tyr Ala Ala Cys Xaa' Thr Gly Cys | (SEQ ID NO: 3144) |
| Pro Gly Thr Cys Gly Xaa' Glu Ile Xaa' Cys Ala Xaa' Tyr Ala Ala Cys Thr Gly Cys Xaa' | (SEQ ID NO: 3145) |
| Pro Gly Thr Cys Gly Xaa' Glu Ile Xaa' Cys Ala Xaa' Tyr Ala Ala Cys Thr Gly Cys | (SEQ ID NO: 3146) |
| Pro Gly Thr Cys Gly Xaa' Glu Ile Xaa' Cys Xaa' Ala Xaa' Ala Ala Cys Thr Gly Cys | (SEQ ID NO: 3147) |
| Pro Gly Thr Cys Gly Xaa' Glu Ile Xaa' Cys Xaa' Ala Xaa' Ala Cys Xaa' Ala Cys Thr Gly Cys | (SEQ ID NO: 3148) |
| Pro Gly Thr Cys Gly Xaa' Glu Ile Xaa' Cys Xaa' Ala Xaa' Ala Xaa' Ala Cys Thr Gly Cys | (SEQ ID NO: 3149) |
| Pro Gly Thr Cys Gly Xaa' Glu Ile Xaa' Cys Xaa' Ala Xaa' Ala Ala Xaa' Cys Thr Gly Cys | (SEQ ID NO: 3150) |
| Pro Gly Thr Cys Gly Xaa' Glu Ile Xaa' Cys Xaa' Ala Xaa' Ala Ala Cys Xaa' Thr Gly Cys | (SEQ ID NO: 3151) |
| Pro Gly Thr Cys Gly Xaa' Glu Ile Xaa' Cys Xaa' Ala Xaa' Ala Ala Cys Thr Gly Xaa' Cys | (SEQ ID NO: 3152) |
| Pro Gly Thr Cys Gly Xaa' Glu Ile Xaa' Cys Xaa' Ala Xaa' Ala Ala Cys Thr Gly Cys Xaa' | (SEQ ID NO: 3153) |
| Pro Gly Thr Cys Gly Xaa' Glu Ile Xaa' Cys Xaa' Ala Tyr Xaa' Ala Ala Cys Thr Gly Cys | (SEQ ID NO: 3154) |
| Pro Gly Thr Cys Gly Xaa' Glu Ile Xaa' Cys Xaa' Ala Tyr Xaa' Ala Xaa' Ala Cys Thr Gly Cys | (SEQ ID NO: 3155) |
| Pro Gly Thr Cys Gly Xaa' Glu Ile Xaa' Cys Xaa' Ala Tyr Xaa' Ala Ala Xaa' Cys Thr Gly Cys | (SEQ ID NO: 3156) |
| Pro Gly Thr Cys Gly Xaa' Glu Ile Xaa' Cys Xaa' Ala Tyr Xaa' Ala Ala Cys Xaa' Thr Gly Cys | (SEQ ID NO: 3157) |
| Pro Gly Thr Cys Gly Xaa' Glu Ile Xaa' Cys Xaa' Ala Tyr Xaa' Ala Ala Cys Thr Gly Xaa' Cys | (SEQ ID NO: 3158) |
| Pro Gly Thr Cys Gly Xaa' Glu Ile Xaa' Cys Xaa' Ala Tyr Xaa' Ala Ala Cys Thr Gly Cys Xaa' | (SEQ ID NO: 3159) |
| Pro Gly Thr Cys Gly Xaa' Glu Ile Xaa' Cys Xaa' Ala Tyr Ala Xaa' Ala Cys Thr Gly Cys | (SEQ ID NO: 3160) |
| Pro Gly Thr Cys Gly Xaa' Glu Ile Xaa' Cys Xaa' Ala Tyr Ala Xaa' Ala Xaa' Cys Thr Gly Cys | (SEQ ID NO: 3161) |
| Pro Gly Thr Cys Gly Xaa' Glu Ile Xaa' Cys Xaa' Ala Tyr Ala Xaa' Ala Cys Xaa' Thr Gly Cys | (SEQ ID NO: 3162) |
| Pro Gly Thr Cys Gly Xaa' Glu Ile Xaa' Cys Xaa' Ala Tyr Ala Xaa' Ala Cys Thr Gly Xaa' Cys | (SEQ ID NO: 3163) |
| Pro Gly Thr Cys Gly Xaa' Glu Ile Xaa' Cys Xaa' Ala Tyr Ala Xaa' Ala Cys Thr Gly Cys Xaa' | (SEQ ID NO: 3164) |
| Pro Gly Thr Cys Gly Xaa' Glu Ile Xaa' Cys Xaa' Ala Tyr Ala Ala Xaa' Cys Thr Gly Cys | (SEQ ID NO: 3165) |
| Pro Gly Thr Cys Gly Xaa' Glu Ile Xaa' Cys Xaa' Ala Tyr Ala Ala Xaa' Cys Thr Gly Cys Xaa' | (SEQ ID NO: 3166) |

FIG. 2

| | | | | | | | | | | | |
|---|---|---|---|---|---|---|---|---|---|---|---|
| Pro Gly Thr Cys Gly Xaa' Glu Ile Xaa' Cys Ala Tyr Ala Ala Cys Xaa' Thr Gly Cys | (SEQ ID NO: 3167) |
| Pro Gly Thr Cys Gly Xaa' Glu Ile Xaa' Cys Ala Tyr Ala Ala Cys Xaa' Thr Gly Cys | (SEQ ID NO: 3168) |
| Pro Gly Thr Cys Gly Xaa' Glu Ile Xaa' Cys Ala Tyr Ala Ala Cys Xaa' Thr Gly Cys | (SEQ ID NO: 3169) |
| Pro Gly Thr Cys Gly Xaa' Glu Ile Xaa' Cys Ala Tyr Ala Ala Cys Xaa' Thr Gly Cys Xaa' | (SEQ ID NO: 3170) |
| Pro Gly Thr Cys Gly Xaa' Glu Ile Xaa' Cys Ala Tyr Ala Ala Cys Xaa' Thr Gly Cys | (SEQ ID NO: 3171) |
| Pro Gly Thr Cys Gly Xaa' Glu Ile Xaa' Cys Ala Tyr Ala Ala Cys Xaa' Thr Gly Cys | (SEQ ID NO: 3172) |
| Pro Gly Thr Cys Gly Xaa' Glu Ile Xaa' Cys Ala Tyr Ala Ala Cys Thr Xaa' Gly Cys | (SEQ ID NO: 3173) |
| Pro Gly Thr Cys Gly Xaa' Glu Ile Xaa' Cys Ala Tyr Ala Ala Cys Xaa' Gly Xaa' Cys | (SEQ ID NO: 3174) |
| Pro Gly Thr Cys Gly Xaa' Glu Ile Xaa' Cys Ala Tyr Ala Ala Cys Thr Xaa' Gly Cys Xaa' | (SEQ ID NO: 3175) |
| Pro Gly Thr Cys Gly Xaa' Glu Ile Xaa' Cys Ala Tyr Ala Ala Cys Thr Gly Xaa' Cys | (SEQ ID NO: 3176) |
| Pro Gly Thr Cys Gly Xaa' Glu Ile Xaa' Cys Ala Tyr Ala Ala Cys Thr Gly Xaa' Cys | (SEQ ID NO: 3177) |
| Pro Gly Thr Cys Gly Xaa' Glu Ile Xaa' Cys Ala Tyr Ala Ala Cys Thr Gly Xaa' Cys Xaa' | (SEQ ID NO: 3178) |
| Pro Gly Thr Cys Gly Xaa' Glu Ile Xaa' Cys Ala Tyr Ala Ala Cys Thr Gly Cys Xaa' | (SEQ ID NO: 3179) |
| Pro Gly Thr Cys Gly Xaa' Glu Ile Xaa' Cys Ala Tyr Ala Ala Cys Thr Gly Cys Xaa' | (SEQ ID NO: 3180) |
| Pro Gly Thr Cys Gly Xaa' Glu Ile Xaa' Cys Ala Tyr Ala Ala Cys Thr Gly Cys Xaa' Xaa' | (SEQ ID NO: 3181) |
| Pro Gly Thr Cys Gly Xaa' Glu Ile Cys Xaa' Ala Tyr Ala Ala Cys Thr Gly Cys | (SEQ ID NO: 3182) |
| Pro Gly Thr Cys Gly Xaa' Glu Ile Cys Xaa' Xaa' Ala Tyr Ala Ala Cys Thr Gly Cys | (SEQ ID NO: 3183) |
| Pro Gly Thr Cys Gly Xaa' Glu Ile Cys Xaa' Xaa' Ala Tyr Ala Ala Cys Thr Gly Cys | (SEQ ID NO: 3184) |
| Pro Gly Thr Cys Gly Xaa' Glu Ile Cys Xaa' Xaa' Ala Tyr Ala Ala Cys Thr Gly Cys | (SEQ ID NO: 3185) |
| Pro Gly Thr Cys Gly Xaa' Glu Ile Cys Xaa' Ala Xaa' Tyr Ala Ala Cys Thr Gly Cys | (SEQ ID NO: 3186) |
| Pro Gly Thr Cys Gly Xaa' Glu Ile Cys Xaa' Ala Xaa' Tyr Ala Ala Cys Thr Gly Cys | (SEQ ID NO: 3187) |
| Pro Gly Thr Cys Gly Xaa' Glu Ile Cys Xaa' Ala Tyr Ala Ala Xaa' Cys Thr Gly Cys | (SEQ ID NO: 3188) |
| Pro Gly Thr Cys Gly Xaa' Glu Ile Cys Xaa' Ala Tyr Ala Ala Cys Xaa' Thr Gly Cys | (SEQ ID NO: 3189) |
| Pro Gly Thr Cys Gly Xaa' Glu Ile Cys Xaa' Ala Tyr Ala Ala Cys Xaa' Thr Gly Cys | (SEQ ID NO: 3190) |
| Pro Gly Thr Cys Gly Xaa' Glu Ile Cys Xaa' Ala Tyr Ala Ala Cys Thr Gly Xaa' Cys | (SEQ ID NO: 3191) |
| Pro Gly Thr Cys Gly Xaa' Glu Ile Cys Xaa' Ala Tyr Ala Ala Cys Thr Gly Cys Xaa' | (SEQ ID NO: 3192) |
| Pro Gly Thr Cys Gly Xaa' Glu Ile Cys Ala Xaa' Tyr Ala Ala Cys Thr Gly Cys | (SEQ ID NO: 3193) |
| Pro Gly Thr Cys Gly Xaa' Glu Ile Cys Ala Xaa' Tyr Ala Ala Cys Thr Gly Cys | (SEQ ID NO: 3194) |
| Pro Gly Thr Cys Gly Xaa' Glu Ile Cys Ala Xaa' Tyr Ala Ala Cys Thr Gly Cys | (SEQ ID NO: 3195) |
| Pro Gly Thr Cys Gly Xaa' Glu Ile Cys Ala Xaa' Tyr Ala Ala Cys Thr Gly Cys | (SEQ ID NO: 3196) |
| Pro Gly Thr Cys Gly Xaa' Glu Ile Cys Ala Xaa' Tyr Ala Ala Xaa' Cys Thr Gly Cys | (SEQ ID NO: 3197) |
| Pro Gly Thr Cys Gly Xaa' Glu Ile Cys Ala Xaa' Tyr Ala Ala Cys Thr Xaa' Gly Cys | (SEQ ID NO: 3198) |
| Pro Gly Thr Cys Gly Xaa' Glu Ile Cys Ala Xaa' Tyr Ala Ala Cys Thr Xaa' Gly Cys | (SEQ ID NO: 3199) |
| Pro Gly Thr Cys Gly Xaa' Glu Ile Cys Xaa' Ala Tyr Ala Ala Cys Thr Gly Cys Xaa' | (SEQ ID NO: 3200) |

FIG. 2

| | | |
|---|---|---|
| Pro Gly Thr Cys Gly Xaa' Glu Ile Cys Xaa' Ala Tyr Xaa' Ala Ala Cys Thr Gly Cys | (SEQID NO: 3201) |
| Pro Gly Thr Cys Gly Xaa' Glu Ile Cys Xaa' Ala Tyr Xaa' Ala Ala Cys Thr Gly Cys | (SEQID NO: 3202) |
| Pro Gly Thr Cys Gly Xaa' Glu Ile Cys Xaa' Ala Tyr Xaa' Ala Xaa' Ala Cys Thr Gly Cys | (SEQID NO: 3203) |
| Pro Gly Thr Cys Gly Xaa' Glu Ile Cys Xaa' Ala Tyr Xaa' Ala Xaa' Ala Cys Thr Gly Cys | (SEQID NO: 3204) |
| Pro Gly Thr Cys Gly Xaa' Glu Ile Cys Xaa' Ala Tyr Xaa' Ala Ala Cys Xaa' Thr Gly Cys | (SEQID NO: 3205) |
| Pro Gly Thr Cys Gly Xaa' Glu Ile Cys Xaa' Ala Tyr Xaa' Ala Ala Cys Xaa' Thr Gly Cys | (SEQID NO: 3206) |
| Pro Gly Thr Cys Gly Xaa' Glu Ile Cys Xaa' Ala Tyr Xaa' Ala Ala Cys Thr Gly Xaa' Cys | (SEQID NO: 3207) |
| Pro Gly Thr Cys Gly Xaa' Glu Ile Cys Xaa' Ala Tyr Xaa' Ala Ala Cys Thr Gly Cys Xaa' | (SEQID NO: 3208) |
| Pro Gly Thr Cys Gly Xaa' Glu Ile Cys Xaa' Ala Tyr Xaa' Ala Xaa' Ala Cys Thr Gly Cys | (SEQID NO: 3209) |
| Pro Gly Thr Cys Gly Xaa' Glu Ile Cys Xaa' Ala Tyr Ala Xaa' Ala Xaa' Ala Cys Thr Gly Cys | (SEQID NO: 3210) |
| Pro Gly Thr Cys Gly Xaa' Glu Ile Cys Xaa' Ala Tyr Ala Xaa' Ala Cys Xaa' Thr Gly Cys | (SEQID NO: 3211) |
| Pro Gly Thr Cys Gly Xaa' Glu Ile Cys Xaa' Ala Tyr Xaa' Ala Xaa' Ala Cys Xaa' Thr Gly Cys | (SEQID NO: 3212) |
| Pro Gly Thr Cys Gly Xaa' Glu Ile Cys Xaa' Ala Tyr Xaa' Ala Ala Cys Thr Xaa' Gly Cys | (SEQID NO: 3213) |
| Pro Gly Thr Cys Gly Xaa' Glu Ile Cys Xaa' Ala Tyr Xaa' Ala Ala Cys Thr Xaa' Gly Cys | (SEQID NO: 3214) |
| Pro Gly Thr Cys Gly Xaa' Glu Ile Cys Xaa' Ala Tyr Xaa' Ala Ala Cys Thr Gly Cys Xaa' | (SEQID NO: 3215) |
| Pro Gly Thr Cys Gly Xaa' Glu Ile Cys Xaa' Ala Tyr Xaa' Ala Ala Cys Thr Gly Cys Xaa' | (SEQID NO: 3216) |
| Pro Gly Thr Cys Gly Xaa' Glu Ile Cys Xaa' Ala Tyr Ala Xaa' Ala Xaa' Cys Thr Gly Cys | (SEQID NO: 3217) |
| Pro Gly Thr Cys Gly Xaa' Glu Ile Cys Xaa' Ala Tyr Ala Xaa' Ala Xaa' Cys Xaa' Thr Gly Cys | (SEQID NO: 3218) |
| Pro Gly Thr Cys Gly Xaa' Glu Ile Cys Xaa' Ala Tyr Ala Xaa' Ala Cys Xaa' Thr Gly Cys | (SEQID NO: 3219) |
| Pro Gly Thr Cys Gly Xaa' Glu Ile Cys Xaa' Ala Tyr Ala Xaa' Ala Cys Thr Gly Xaa' Cys | (SEQID NO: 3220) |
| Pro Gly Thr Cys Gly Xaa' Glu Ile Cys Xaa' Ala Tyr Ala Xaa' Ala Cys Thr Gly Cys Xaa' | (SEQID NO: 3221) |
| Pro Gly Thr Cys Gly Xaa' Glu Ile Cys Xaa' Ala Tyr Ala Xaa' Ala Xaa' Cys Thr Gly Cys | (SEQID NO: 3222) |
| Pro Gly Thr Cys Gly Xaa' Glu Ile Cys Xaa' Ala Tyr Ala Xaa' Ala Xaa' Cys Xaa' Thr Gly Cys | (SEQID NO: 3223) |
| Pro Gly Thr Cys Gly Xaa' Glu Ile Cys Xaa' Ala Tyr Ala Xaa' Ala Cys Xaa' Thr Xaa' Gly Cys | (SEQID NO: 3224) |
| Pro Gly Thr Cys Gly Xaa' Glu Ile Cys Xaa' Ala Tyr Ala Xaa' Ala Cys Thr Xaa' Gly Xaa' Cys | (SEQID NO: 3225) |
| Pro Gly Thr Cys Gly Xaa' Glu Ile Cys Xaa' Ala Tyr Ala Xaa' Ala Cys Thr Gly Xaa' Cys Xaa' | (SEQID NO: 3226) |
| Pro Gly Thr Cys Gly Xaa' Glu Ile Cys Xaa' Ala Tyr Ala Xaa' Ala Xaa' Cys Thr Gly Cys | (SEQID NO: 3227) |
| Pro Gly Thr Cys Gly Xaa' Glu Ile Cys Xaa' Ala Tyr Ala Xaa' Ala Xaa' Cys Xaa' Gly Cys | (SEQID NO: 3228) |
| Pro Gly Thr Cys Gly Xaa' Glu Ile Cys Xaa' Ala Tyr Ala Xaa' Ala Cys Xaa' Gly Xaa' Cys | (SEQID NO: 3229) |
| Pro Gly Thr Cys Gly Xaa' Glu Ile Cys Xaa' Ala Tyr Ala Xaa' Ala Cys Thr Xaa' Gly Cys Xaa' | (SEQID NO: 3230) |
| Pro Gly Thr Cys Gly Xaa' Glu Ile Cys Xaa' Ala Tyr Ala Xaa' Ala Cys Thr Gly Xaa' Cys Xaa' | (SEQID NO: 3231) |
| Pro Gly Thr Cys Gly Xaa' Glu Ile Cys Xaa' Ala Tyr Ala Xaa' Ala Xaa' Cys Xaa' Gly Cys | (SEQID NO: 3232) |
| Pro Gly Thr Cys Gly Xaa' Glu Ile Cys Xaa' Ala Tyr Ala Xaa' Ala Xaa' Cys Xaa' Gly Cys Xaa' | (SEQID NO: 3233) |
| Pro Gly Thr Cys Gly Xaa' Glu Ile Cys Xaa' Ala Tyr Ala Xaa' Ala Cys Thr Gly Cys Xaa' | (SEQID NO: 3234) |

FIG. 2

| Sequence | SEQ ID NO |
|---|---|
| Pro Gly Thr Cys Gly Xaa' Glu Ile Cys Xaa' Ala Tyr Ala Ala Cys Thr Gly Cys Xaa' Xaa' | (SEQID NO: 3235) |
| Pro Gly Thr Cys Gly Xaa' Glu Ile Cys Ala Xaa' Tyr Ala Ala Cys Thr Gly Cys | (SEQID NO: 3236) |
| Pro Gly Thr Cys Gly Xaa' Glu Ile Cys Ala Xaa' Tyr Ala Ala Cys Thr Gly Cys | (SEQID NO: 3237) |
| Pro Gly Thr Cys Gly Xaa' Glu Ile Cys Ala Xaa' Xaa' Tyr Ala Ala Cys Thr Gly Cys | (SEQID NO: 3238) |
| Pro Gly Thr Cys Gly Xaa' Glu Ile Cys Ala Xaa' Xaa' Tyr Xaa' Ala Ala Cys Thr Gly Cys | (SEQID NO: 3239) |
| Pro Gly Thr Cys Gly Xaa' Glu Ile Cys Ala Xaa' Xaa' Tyr Xaa' Ala Ala Cys Thr Gly Cys | (SEQID NO: 3240) |
| Pro Gly Thr Cys Gly Xaa' Glu Ile Cys Ala Xaa' Xaa' Tyr Ala Xaa' Ala Cys Thr Gly Cys | (SEQID NO: 3241) |
| Pro Gly Thr Cys Gly Xaa' Glu Ile Cys Ala Xaa' Xaa' Tyr Ala Ala Xaa' Cys Thr Gly Cys | (SEQID NO: 3242) |
| Pro Gly Thr Cys Gly Xaa' Glu Ile Cys Ala Xaa' Xaa' Tyr Ala Ala Xaa' Cys Thr Gly Cys | (SEQID NO: 3243) |
| Pro Gly Thr Cys Gly Xaa' Glu Ile Cys Ala Xaa' Xaa' Tyr Ala Ala Cys Thr Xaa' Gly Cys | (SEQID NO: 3244) |
| Pro Gly Thr Cys Gly Xaa' Glu Ile Cys Ala Xaa' Xaa' Tyr Ala Ala Cys Thr Gly Xaa' Cys | (SEQID NO: 3245) |
| Pro Gly Thr Cys Gly Xaa' Glu Ile Cys Ala Xaa' Xaa' Tyr Ala Ala Cys Thr Gly Cys Xaa' | (SEQID NO: 3246) |
| Pro Gly Thr Cys Gly Xaa' Glu Ile Cys Ala Xaa' Xaa' Tyr Xaa' Ala Ala Cys Thr Gly Cys | (SEQID NO: 3247) |
| Pro Gly Thr Cys Gly Xaa' Glu Ile Cys Ala Xaa' Xaa' Tyr Xaa' Ala Xaa' Ala Cys Thr Gly Cys | (SEQID NO: 3248) |
| Pro Gly Thr Cys Gly Xaa' Glu Ile Cys Ala Xaa' Xaa' Tyr Xaa' Ala Ala Xaa' Cys Thr Gly Cys | (SEQID NO: 3249) |
| Pro Gly Thr Cys Gly Xaa' Glu Ile Cys Ala Xaa' Xaa' Tyr Xaa' Ala Ala Cys Xaa' Thr Gly Cys | (SEQID NO: 3250) |
| Pro Gly Thr Cys Gly Xaa' Glu Ile Cys Ala Xaa' Xaa' Tyr Xaa' Ala Ala Cys Thr Xaa' Gly Cys | (SEQID NO: 3251) |
| Pro Gly Thr Cys Gly Xaa' Glu Ile Cys Ala Xaa' Xaa' Tyr Xaa' Ala Ala Cys Thr Gly Xaa' Cys | (SEQID NO: 3252) |
| Pro Gly Thr Cys Gly Xaa' Glu Ile Cys Ala Xaa' Xaa' Tyr Xaa' Ala Ala Cys Thr Gly Cys Xaa' | (SEQID NO: 3253) |
| Pro Gly Thr Cys Gly Xaa' Glu Ile Cys Ala Xaa' Xaa' Tyr Ala Xaa' Ala Ala Cys Thr Gly Cys | (SEQID NO: 3254) |
| Pro Gly Thr Cys Gly Xaa' Glu Ile Cys Ala Xaa' Xaa' Tyr Ala Xaa' Ala Xaa' Cys Thr Gly Cys | (SEQID NO: 3255) |
| Pro Gly Thr Cys Gly Xaa' Glu Ile Cys Ala Xaa' Xaa' Tyr Ala Xaa' Ala Cys Xaa' Thr Gly Cys | (SEQID NO: 3256) |
| Pro Gly Thr Cys Gly Xaa' Glu Ile Cys Ala Xaa' Xaa' Tyr Ala Xaa' Ala Cys Thr Xaa' Gly Cys | (SEQID NO: 3257) |
| Pro Gly Thr Cys Gly Xaa' Glu Ile Cys Ala Xaa' Xaa' Tyr Ala Xaa' Ala Cys Thr Gly Xaa' Cys | (SEQID NO: 3258) |
| Pro Gly Thr Cys Gly Xaa' Glu Ile Cys Ala Xaa' Xaa' Tyr Ala Xaa' Ala Cys Thr Gly Cys Xaa' | (SEQID NO: 3259) |
| Pro Gly Thr Cys Gly Xaa' Glu Ile Cys Ala Xaa' Xaa' Tyr Ala Ala Xaa' Cys Thr Gly Cys | (SEQID NO: 3260) |
| Pro Gly Thr Cys Gly Xaa' Glu Ile Cys Ala Xaa' Xaa' Tyr Ala Ala Xaa' Cys Thr Gly Cys | (SEQID NO: 3261) |
| Pro Gly Thr Cys Gly Xaa' Glu Ile Cys Ala Xaa' Xaa' Tyr Ala Ala Xaa' Cys Xaa' Thr Gly Cys | (SEQID NO: 3262) |
| Pro Gly Thr Cys Gly Xaa' Glu Ile Cys Ala Xaa' Xaa' Tyr Ala Ala Xaa' Cys Thr Xaa' Gly Cys | (SEQID NO: 3263) |
| Pro Gly Thr Cys Gly Xaa' Glu Ile Cys Ala Xaa' Xaa' Tyr Ala Ala Xaa' Cys Thr Gly Xaa' Cys | (SEQID NO: 3264) |
| Pro Gly Thr Cys Gly Xaa' Glu Ile Cys Ala Xaa' Xaa' Tyr Ala Ala Xaa' Cys Thr Gly Cys Xaa' | (SEQID NO: 3265) |
| Pro Gly Thr Cys Gly Xaa' Glu Ile Cys Ala Xaa' Xaa' Tyr Ala Ala Cys Xaa' Thr Gly Cys | (SEQID NO: 3266) |
| Pro Gly Thr Cys Gly Xaa' Glu Ile Cys Ala Xaa' Xaa' Tyr Ala Ala Cys Xaa' Thr Gly Cys | (SEQID NO: 3267) |
| Pro Gly Thr Cys Gly Xaa' Glu Ile Cys Ala Xaa' Xaa' Tyr Ala Ala Cys Xaa' Xaa' Thr Gly Cys | (SEQID NO: 3268) |

FIG. 2

| | | | | | | | | | | |
|---|---|---|---|---|---|---|---|---|---|---|
| Pro Gly Thr Cys Gly Xaa' Glu Ile Cys Ala Xaa' Tyr Ala Ala Cys Xaa' Thr Xaa' Gly Cys | (SEQ ID NO: 3269) |
| Pro Gly Thr Cys Gly Xaa' Glu Ile Cys Ala Xaa' Tyr Ala Ala Cys Xaa' Thr Gly Xaa' Cys | (SEQ ID NO: 3270) |
| Pro Gly Thr Cys Gly Xaa' Glu Ile Cys Ala Xaa' Tyr Ala Ala Cys Xaa' Thr Gly Cys Xaa' | (SEQ ID NO: 3271) |
| Pro Gly Thr Cys Gly Xaa' Glu Ile Cys Ala Xaa' Tyr Ala Ala Cys Thr Xaa' Gly Cys | (SEQ ID NO: 3272) |
| Pro Gly Thr Cys Gly Xaa' Glu Ile Cys Ala Xaa' Tyr Ala Ala Cys Thr Gly Cys | (SEQ ID NO: 3273) |
| Pro Gly Thr Cys Gly Xaa' Glu Ile Cys Ala Xaa' Tyr Ala Ala Cys Xaa' Thr Xaa' Gly Cys | (SEQ ID NO: 3274) |
| Pro Gly Thr Cys Gly Xaa' Glu Ile Cys Ala Xaa' Tyr Ala Ala Cys Xaa' Thr Gly Xaa' Cys | (SEQ ID NO: 3275) |
| Pro Gly Thr Cys Gly Xaa' Glu Ile Cys Ala Xaa' Tyr Ala Ala Cys Xaa' Thr Gly Cys Xaa' | (SEQ ID NO: 3276) |
| Pro Gly Thr Cys Gly Xaa' Glu Ile Cys Ala Xaa' Tyr Ala Ala Cys Thr Xaa' Gly Xaa' Cys | (SEQ ID NO: 3277) |
| Pro Gly Thr Cys Gly Xaa' Glu Ile Cys Ala Xaa' Tyr Ala Ala Cys Thr Xaa' Gly Cys Xaa' | (SEQ ID NO: 3278) |
| Pro Gly Thr Cys Gly Xaa' Glu Ile Cys Ala Xaa' Tyr Ala Ala Cys Thr Gly Xaa' Cys Xaa' | (SEQ ID NO: 3279) |
| Pro Gly Thr Cys Gly Xaa' Glu Ile Cys Ala Xaa' Tyr Ala Ala Cys Xaa' Thr Gly Cys Xaa' | (SEQ ID NO: 3280) |
| Pro Gly Thr Cys Gly Xaa' Glu Ile Cys Ala Xaa' Tyr Xaa' Ala Ala Cys Thr Gly Cys | (SEQ ID NO: 3281) |
| Pro Gly Thr Cys Gly Xaa' Glu Ile Cys Ala Xaa' Tyr Xaa' Ala Ala Cys Thr Gly Cys | (SEQ ID NO: 3282) |
| Pro Gly Thr Cys Gly Xaa' Glu Ile Cys Ala Xaa' Tyr Xaa' Ala Ala Cys Xaa' Thr Gly Cys | (SEQ ID NO: 3283) |
| Pro Gly Thr Cys Gly Xaa' Glu Ile Cys Ala Xaa' Tyr Xaa' Ala Ala Xaa' Ala Cys Thr Gly Cys | (SEQ ID NO: 3284) |
| Pro Gly Thr Cys Gly Xaa' Glu Ile Cys Ala Xaa' Tyr Xaa' Ala Ala Xaa' Cys Thr Gly Cys | (SEQ ID NO: 3285) |
| Pro Gly Thr Cys Gly Xaa' Glu Ile Cys Ala Xaa' Tyr Xaa' Ala Ala Xaa' Cys Xaa' Thr Gly Cys | (SEQ ID NO: 3286) |
| Pro Gly Thr Cys Gly Xaa' Glu Ile Cys Ala Xaa' Tyr Xaa' Ala Ala Xaa' Cys Thr Xaa' Gly Cys | (SEQ ID NO: 3287) |
| Pro Gly Thr Cys Gly Xaa' Glu Ile Cys Ala Xaa' Tyr Xaa' Ala Ala Xaa' Cys Thr Gly Xaa' Cys | (SEQ ID NO: 3288) |
| Pro Gly Thr Cys Gly Xaa' Glu Ile Cys Ala Xaa' Tyr Xaa' Ala Ala Xaa' Cys Thr Gly Cys Xaa' | (SEQ ID NO: 3289) |
| Pro Gly Thr Cys Gly Xaa' Glu Ile Cys Ala Xaa' Tyr Xaa' Ala Xaa' Ala Cys Thr Gly Cys | (SEQ ID NO: 3290) |
| Pro Gly Thr Cys Gly Xaa' Glu Ile Cys Ala Xaa' Tyr Xaa' Ala Xaa' Ala Cys Xaa' Thr Gly Cys | (SEQ ID NO: 3291) |
| Pro Gly Thr Cys Gly Xaa' Glu Ile Cys Ala Xaa' Tyr Xaa' Ala Xaa' Ala Cys Thr Xaa' Gly Cys | (SEQ ID NO: 3292) |
| Pro Gly Thr Cys Gly Xaa' Glu Ile Cys Ala Xaa' Tyr Xaa' Ala Xaa' Ala Cys Thr Gly Xaa' Cys | (SEQ ID NO: 3293) |
| Pro Gly Thr Cys Gly Xaa' Glu Ile Cys Ala Xaa' Tyr Xaa' Ala Xaa' Ala Cys Thr Gly Cys Xaa' | (SEQ ID NO: 3294) |
| Pro Gly Thr Cys Gly Xaa' Glu Ile Cys Ala Xaa' Tyr Xaa' Ala Xaa' Ala Cys Xaa' Thr Gly Cys | (SEQ ID NO: 3295) |
| Pro Gly Thr Cys Gly Xaa' Glu Ile Cys Ala Xaa' Tyr Xaa' Ala Xaa' Ala Cys Thr Xaa' Gly Cys | (SEQ ID NO: 3296) |
| Pro Gly Thr Cys Gly Xaa' Glu Ile Cys Ala Xaa' Tyr Xaa' Ala Xaa' Ala Cys Thr Gly Cys Xaa' | (SEQ ID NO: 3297) |
| Pro Gly Thr Cys Gly Xaa' Glu Ile Cys Ala Xaa' Tyr Xaa' Ala Xaa' Ala Xaa' Cys Thr Gly Cys | (SEQ ID NO: 3298) |
| Pro Gly Thr Cys Gly Xaa' Glu Ile Cys Ala Xaa' Tyr Xaa' Ala Xaa' Ala Xaa' Cys Thr Gly Cys | (SEQ ID NO: 3299) |
| Pro Gly Thr Cys Gly Xaa' Glu Ile Cys Ala Xaa' Tyr Xaa' Ala Xaa' Ala Xaa' Cys Thr Gly Cys | (SEQ ID NO: 3300) |
| Pro Gly Thr Cys Gly Xaa' Glu Ile Cys Ala Xaa' Tyr Xaa' Ala Xaa' Ala Xaa' Cys Thr Gly Cys Xaa' | (SEQ ID NO: 3301) |
| Pro Gly Thr Cys Gly Xaa' Glu Ile Cys Ala Xaa' Tyr Xaa' Ala Xaa' Ala Xaa' Cys Thr Gly Cys Xaa' | (SEQ ID NO: 3302) |

FIG. 2

| Sequence | SEQ ID NO |
|---|---|
| Pro Gly Thr Cys Gly Xaa' Glu Ile Cys Ala Tyr Xaa' Ala Ala Cys Xaa' Thr Gly Cys | (SEQ ID NO: 3303) |
| Pro Gly Thr Cys Gly Xaa' Glu Ile Cys Ala Tyr Xaa' Ala Ala Cys Xaa' Xaa' Thr Gly Cys | (SEQ ID NO: 3304) |
| Pro Gly Thr Cys Gly Xaa' Glu Ile Cys Ala Tyr Xaa' Ala Ala Cys Xaa' Thr Xaa' Gly Cys | (SEQ ID NO: 3305) |
| Pro Gly Thr Cys Gly Xaa' Glu Ile Cys Ala Tyr Xaa' Ala Ala Cys Xaa' Thr Gly Xaa' Cys | (SEQ ID NO: 3306) |
| Pro Gly Thr Cys Gly Xaa' Glu Ile Cys Ala Tyr Xaa' Ala Ala Cys Xaa' Thr Gly Cys Xaa' | (SEQ ID NO: 3307) |
| Pro Gly Thr Cys Gly Xaa' Glu Ile Cys Ala Tyr Xaa' Ala Ala Cys Xaa' Thr Gly Cys | (SEQ ID NO: 3308) |
| Pro Gly Thr Cys Gly Xaa' Glu Ile Cys Ala Tyr Xaa' Ala Ala Cys Xaa' Xaa' Thr Gly Cys | (SEQ ID NO: 3309) |
| Pro Gly Thr Cys Gly Xaa' Glu Ile Cys Ala Tyr Xaa' Ala Ala Cys Xaa' Thr Xaa' Gly Cys | (SEQ ID NO: 3310) |
| Pro Gly Thr Cys Gly Xaa' Glu Ile Cys Ala Tyr Xaa' Ala Ala Cys Xaa' Thr Gly Xaa' Cys | (SEQ ID NO: 3311) |
| Pro Gly Thr Cys Gly Xaa' Glu Ile Cys Ala Tyr Xaa' Ala Ala Cys Xaa' Thr Gly Cys Xaa' | (SEQ ID NO: 3312) |
| Pro Gly Thr Cys Gly Xaa' Glu Ile Cys Ala Tyr Xaa' Ala Ala Cys Thr Gly Xaa' Cys | (SEQ ID NO: 3313) |
| Pro Gly Thr Cys Gly Xaa' Glu Ile Cys Ala Tyr Xaa' Ala Ala Cys Thr Gly Cys Xaa' | (SEQ ID NO: 3314) |
| Pro Gly Thr Cys Gly Xaa' Glu Ile Cys Ala Tyr Ala Ala Ala Cys Thr Gly Cys Xaa' | (SEQ ID NO: 3315) |
| Pro Gly Thr Cys Gly Xaa' Glu Ile Cys Ala Tyr Ala Ala Ala Cys Thr Gly Cys | (SEQ ID NO: 3316) |
| Pro Gly Thr Cys Gly Xaa' Glu Ile Cys Ala Tyr Ala Ala Ala Cys Thr Gly Cys | (SEQ ID NO: 3317) |
| Pro Gly Thr Cys Gly Xaa' Glu Ile Cys Ala Tyr Ala Ala Xaa' Ala Cys Thr Gly Cys | (SEQ ID NO: 3318) |
| Pro Gly Thr Cys Gly Xaa' Glu Ile Cys Ala Tyr Ala Ala Xaa' Ala Cys Thr Gly Cys | (SEQ ID NO: 3319) |
| Pro Gly Thr Cys Gly Xaa' Glu Ile Cys Ala Tyr Ala Ala Xaa' Ala Cys Xaa' Thr Gly Cys | (SEQ ID NO: 3320) |
| Pro Gly Thr Cys Gly Xaa' Glu Ile Cys Ala Tyr Ala Ala Xaa' Ala Cys Xaa' Thr Gly Cys | (SEQ ID NO: 3321) |
| Pro Gly Thr Cys Gly Xaa' Glu Ile Cys Ala Tyr Ala Ala Xaa' Ala Cys Xaa' Thr Gly Cys | (SEQ ID NO: 3322) |
| Pro Gly Thr Cys Gly Xaa' Glu Ile Cys Ala Tyr Ala Ala Xaa' Ala Cys Xaa' Thr Gly Cys | (SEQ ID NO: 3323) |
| Pro Gly Thr Cys Gly Xaa' Glu Ile Cys Ala Tyr Ala Ala Xaa' Ala Cys Xaa' Thr Gly Cys Xaa' | (SEQ ID NO: 3324) |
| Pro Gly Thr Cys Gly Xaa' Glu Ile Cys Ala Tyr Ala Ala Xaa' Ala Cys Xaa' Cys Thr Gly Cys | (SEQ ID NO: 3325) |
| Pro Gly Thr Cys Gly Xaa' Glu Ile Cys Ala Tyr Ala Ala Xaa' Ala Cys Xaa' Cys Thr Gly Cys | (SEQ ID NO: 3326) |
| Pro Gly Thr Cys Gly Xaa' Glu Ile Cys Ala Tyr Ala Ala Xaa' Ala Cys Xaa' Cys Thr Gly Cys | (SEQ ID NO: 3327) |
| Pro Gly Thr Cys Gly Xaa' Glu Ile Cys Ala Tyr Ala Ala Xaa' Ala Cys Xaa' Cys Thr Gly Cys | (SEQ ID NO: 3328) |
| Pro Gly Thr Cys Gly Xaa' Glu Ile Cys Ala Tyr Ala Ala Xaa' Ala Cys Xaa' Cys Thr Gly Cys | (SEQ ID NO: 3329) |
| Pro Gly Thr Cys Gly Xaa' Glu Ile Cys Ala Tyr Ala Ala Xaa' Ala Cys Xaa' Cys Thr Gly Cys Xaa' | (SEQ ID NO: 3330) |
| Pro Gly Thr Cys Gly Xaa' Glu Ile Cys Ala Tyr Ala Ala Xaa' Ala Cys Xaa' Cys Thr Gly Cys | (SEQ ID NO: 3331) |
| Pro Gly Thr Cys Gly Xaa' Glu Ile Cys Ala Tyr Ala Ala Xaa' Ala Cys Xaa' Cys Thr Gly Cys | (SEQ ID NO: 3332) |
| Pro Gly Thr Cys Gly Xaa' Glu Ile Cys Ala Tyr Ala Ala Xaa' Ala Cys Xaa' Cys Thr Gly Cys | (SEQ ID NO: 3333) |
| Pro Gly Thr Cys Gly Xaa' Glu Ile Cys Ala Tyr Ala Ala Xaa' Ala Cys Xaa' Cys Thr Gly Cys | (SEQ ID NO: 3334) |
| Pro Gly Thr Cys Gly Xaa' Glu Ile Cys Ala Tyr Ala Ala Xaa' Ala Cys Xaa' Cys Thr Gly Cys Xaa' | (SEQ ID NO: 3335) |
| Pro Gly Thr Cys Gly Xaa' Glu Ile Cys Ala Tyr Ala Ala Xaa' Ala Cys Ala Cys Thr Gly Cys | (SEQ ID NO: 3336) |

FIG. 2

| | | | | | | | | | | | |
|---|---|---|---|---|---|---|---|---|---|---|---|
| Pro Gly Thr Cys Gly Xaa' | Glu | Ile | Cys | Ala | Tyr | Ala | Xaa' | Ala | Cys | Thr | Xaa' Xaa' Gly Cys | (SEQ ID NO: 3337) |
| Pro Gly Thr Cys Gly Xaa' | Glu | Ile | Cys | Ala | Tyr | Ala | Xaa' | Ala | Cys | Thr | Xaa' Gly Xaa' Cys | (SEQ ID NO: 3338) |
| Pro Gly Thr Cys Gly Xaa' | Glu | Ile | Cys | Ala | Tyr | Ala | Xaa' | Ala | Cys | Thr | Xaa' Gly Cys Xaa' | (SEQ ID NO: 3339) |
| Pro Gly Thr Cys Gly Xaa' | Glu | Ile | Cys | Ala | Tyr | Ala | Xaa' | Ala | Cys | Thr | Gly Xaa' Xaa' Cys | (SEQ ID NO: 3340) |
| Pro Gly Thr Cys Gly Xaa' | Glu | Ile | Cys | Ala | Tyr | Ala | Xaa' | Ala | Cys | Thr | Gly Xaa' Cys Xaa' | (SEQ ID NO: 3341) |
| Pro Gly Thr Cys Gly Xaa' | Glu | Ile | Cys | Ala | Tyr | Ala | Xaa' | Ala | Cys | Thr | Gly Cys Xaa' Xaa' | (SEQ ID NO: 3342) |
| Pro Gly Thr Cys Gly Xaa' | Glu | Ile | Cys | Ala | Tyr | Ala | Xaa' | Ala | Cys | Thr | Cys Thr Gly Cys | (SEQ ID NO: 3343) |
| Pro Gly Thr Cys Gly Xaa' | Glu | Ile | Cys | Ala | Tyr | Ala | Xaa' | Ala | Cys | Thr | Cys Gly Xaa' Xaa' | (SEQ ID NO: 3344) |
| Pro Gly Thr Cys Gly Xaa' | Glu | Ile | Cys | Ala | Tyr | Ala | Ala | Xaa' | Cys | Thr | Xaa' Xaa' Gly Cys | (SEQ ID NO: 3345) |
| Pro Gly Thr Cys Gly Xaa' | Glu | Ile | Cys | Ala | Tyr | Ala | Ala | Xaa' | Cys | Thr | Gly Cys | (SEQ ID NO: 3346) |
| Pro Gly Thr Cys Gly Xaa' | Glu | Ile | Cys | Ala | Tyr | Ala | Ala | Xaa' | Xaa' | Cys | Thr Gly Cys | (SEQ ID NO: 3347) |
| Pro Gly Thr Cys Gly Xaa' | Glu | Ile | Cys | Ala | Tyr | Ala | Ala | Xaa' | Xaa' | Cys | Xaa' Thr Gly Cys | (SEQ ID NO: 3348) |
| Pro Gly Thr Cys Gly Xaa' | Glu | Ile | Cys | Ala | Tyr | Ala | Ala | Xaa' | Xaa' | Cys | Thr Xaa' Gly Cys | (SEQ ID NO: 3349) |
| Pro Gly Thr Cys Gly Xaa' | Glu | Ile | Cys | Ala | Tyr | Ala | Ala | Xaa' | Xaa' | Cys | Thr Gly Xaa' Cys | (SEQ ID NO: 3350) |
| Pro Gly Thr Cys Gly Xaa' | Glu | Ile | Cys | Ala | Tyr | Ala | Ala | Xaa' | Xaa' | Cys | Thr Gly Cys Xaa' | (SEQ ID NO: 3351) |
| Pro Gly Thr Cys Gly Xaa' | Glu | Ile | Cys | Ala | Tyr | Ala | Ala | Xaa' | Xaa' | Cys | Xaa' Thr Gly Cys | (SEQ ID NO: 3352) |
| Pro Gly Thr Cys Gly Xaa' | Glu | Ile | Cys | Ala | Tyr | Ala | Ala | Xaa' | Xaa' | Cys | Xaa' Cys Thr Gly Cys | (SEQ ID NO: 3353) |
| Pro Gly Thr Cys Gly Xaa' | Glu | Ile | Cys | Ala | Tyr | Ala | Ala | Xaa' | Xaa' | Cys | Xaa' Thr Gly Cys | (SEQ ID NO: 3354) |
| Pro Gly Thr Cys Gly Xaa' | Glu | Ile | Cys | Ala | Tyr | Ala | Ala | Xaa' | Xaa' | Cys | Xaa' Cys Thr Gly Cys | (SEQ ID NO: 3355) |
| Pro Gly Thr Cys Gly Xaa' | Glu | Ile | Cys | Ala | Tyr | Ala | Ala | Xaa' | Xaa' | Cys | Xaa' Thr Gly Xaa' Cys | (SEQ ID NO: 3356) |
| Pro Gly Thr Cys Gly Xaa' | Glu | Ile | Cys | Ala | Tyr | Ala | Ala | Xaa' | Xaa' | Cys | Xaa' Thr Gly Cys Xaa' | (SEQ ID NO: 3357) |
| Pro Gly Thr Cys Gly Xaa' | Glu | Ile | Cys | Ala | Tyr | Ala | Ala | Xaa' | Xaa' | Cys | Xaa' Xaa' Gly Cys | (SEQ ID NO: 3358) |
| Pro Gly Thr Cys Gly Xaa' | Glu | Ile | Cys | Ala | Tyr | Ala | Ala | Xaa' | Xaa' | Cys | Xaa' Gly Xaa' Cys | (SEQ ID NO: 3359) |
| Pro Gly Thr Cys Gly Xaa' | Glu | Ile | Cys | Ala | Tyr | Ala | Ala | Xaa' | Xaa' | Cys | Xaa' Gly Cys Xaa' | (SEQ ID NO: 3360) |
| Pro Gly Thr Cys Gly Xaa' | Glu | Ile | Cys | Ala | Tyr | Ala | Ala | Xaa' | Xaa' | Cys | Thr Gly Xaa' Cys | (SEQ ID NO: 3361) |
| Pro Gly Thr Cys Gly Xaa' | Glu | Ile | Cys | Ala | Tyr | Ala | Ala | Xaa' | Xaa' | Cys | Thr Gly Xaa' Xaa' Cys | (SEQ ID NO: 3362) |
| Pro Gly Thr Cys Gly Xaa' | Glu | Ile | Cys | Ala | Tyr | Ala | Ala | Xaa' | Xaa' | Cys | Thr Gly Xaa' Cys Xaa' | (SEQ ID NO: 3363) |
| Pro Gly Thr Cys Gly Xaa' | Glu | Ile | Cys | Ala | Tyr | Ala | Ala | Xaa' | Xaa' | Cys | Thr Gly Cys Xaa' | (SEQ ID NO: 3364) |
| Pro Gly Thr Cys Gly Xaa' | Glu | Ile | Cys | Ala | Tyr | Ala | Ala | Ala | Cys | Xaa' | Xaa' Thr Gly Cys | (SEQ ID NO: 3365) |
| Pro Gly Thr Cys Gly Xaa' | Glu | Ile | Cys | Ala | Tyr | Ala | Ala | Ala | Cys | Xaa' | Thr Gly Cys | (SEQ ID NO: 3366) |
| Pro Gly Thr Cys Gly Xaa' | Glu | Ile | Cys | Ala | Tyr | Ala | Ala | Ala | Cys | Xaa' | Xaa' Thr Gly Cys | (SEQ ID NO: 3367) |
| Pro Gly Thr Cys Gly Xaa' | Glu | Ile | Cys | Ala | Tyr | Ala | Ala | Ala | Cys | Xaa' | Xaa' Xaa' Thr Gly Cys | (SEQ ID NO: 3368) |
| Pro Gly Thr Cys Gly Xaa' | Glu | Ile | Cys | Ala | Tyr | Ala | Ala | Ala | Cys | Xaa' | Xaa' Thr Xaa' Gly Cys | (SEQ ID NO: 3369) |
| Pro Gly Thr Cys Gly Xaa' | Glu | Ile | Cys | Ala | Tyr | Ala | Ala | Ala | Cys | Xaa' | Xaa' Thr Gly Xaa' Cys | (SEQ ID NO: 3370) |

FIG. 2

| | | | | | | | | | | | | | |
|---|---|---|---|---|---|---|---|---|---|---|---|---|---|
| Pro Gly Thr Cys Gly Xaa' Glu Ile Cys Ala Tyr Ala Ala Cys Xaa' Xaa' Thr Gly Cys Xaa' | (SEQ ID NO: 3371) |
| Pro Gly Thr Cys Gly Xaa' Glu Ile Cys Ala Tyr Ala Ala Cys Xaa' Xaa' Thr Xaa' Gly Cys | (SEQ ID NO: 3372) |
| Pro Gly Thr Cys Gly Xaa' Glu Ile Cys Ala Tyr Ala Ala Cys Xaa' Xaa' Thr Xaa' Xaa' Gly Cys | (SEQ ID NO: 3373) |
| Pro Gly Thr Cys Gly Xaa' Glu Ile Cys Ala Tyr Ala Ala Cys Xaa' Xaa' Thr Xaa' Gly Xaa' Cys | (SEQ ID NO: 3374) |
| Pro Gly Thr Cys Gly Xaa' Glu Ile Cys Ala Tyr Ala Ala Cys Xaa' Xaa' Thr Gly Cys Xaa' | (SEQ ID NO: 3375) |
| Pro Gly Thr Cys Gly Xaa' Glu Ile Cys Ala Tyr Ala Ala Cys Xaa' Xaa' Thr Gly Xaa' Cys | (SEQ ID NO: 3376) |
| Pro Gly Thr Cys Gly Xaa' Glu Ile Cys Ala Tyr Ala Ala Cys Xaa' Xaa' Thr Gly Xaa' Xaa' Cys | (SEQ ID NO: 3377) |
| Pro Gly Thr Cys Gly Xaa' Glu Ile Cys Ala Tyr Ala Ala Cys Xaa' Xaa' Thr Gly Xaa' Cys Xaa' | (SEQ ID NO: 3378) |
| Pro Gly Thr Cys Gly Xaa' Glu Ile Cys Ala Tyr Ala Ala Cys Xaa' Thr Gly Cys Xaa' | (SEQ ID NO: 3379) |
| Pro Gly Thr Cys Gly Xaa' Glu Ile Cys Ala Tyr Ala Ala Cys Xaa' Thr Gly Cys Xaa' | (SEQ ID NO: 3380) |
| Pro Gly Thr Cys Gly Xaa' Glu Ile Cys Ala Tyr Ala Ala Cys Xaa' Thr Gly Xaa' Cys Xaa' | (SEQ ID NO: 3381) |
| Pro Gly Thr Cys Gly Xaa' Glu Ile Cys Ala Tyr Ala Ala Cys Thr Xaa' Gly Cys | (SEQ ID NO: 3382) |
| Pro Gly Thr Cys Gly Xaa' Glu Ile Cys Ala Tyr Ala Ala Cys Thr Xaa' Xaa' Gly Cys | (SEQ ID NO: 3383) |
| Pro Gly Thr Cys Gly Xaa' Glu Ile Cys Ala Tyr Ala Ala Cys Thr Xaa' Xaa' Xaa' Gly Cys | (SEQ ID NO: 3384) |
| Pro Gly Thr Cys Gly Xaa' Glu Ile Cys Ala Tyr Ala Ala Cys Thr Xaa' Xaa' Gly Xaa' Cys | (SEQ ID NO: 3385) |
| Pro Gly Thr Cys Gly Xaa' Glu Ile Cys Ala Tyr Ala Ala Cys Thr Xaa' Gly Cys Xaa' | (SEQ ID NO: 3386) |
| Pro Gly Thr Cys Gly Xaa' Glu Ile Cys Ala Tyr Ala Ala Cys Thr Xaa' Gly Xaa' Cys | (SEQ ID NO: 3387) |
| Pro Gly Thr Cys Gly Xaa' Glu Ile Cys Ala Tyr Ala Ala Cys Thr Xaa' Gly Xaa' Xaa' Cys | (SEQ ID NO: 3388) |
| Pro Gly Thr Cys Gly Xaa' Glu Ile Cys Ala Tyr Ala Ala Cys Thr Xaa' Gly Xaa' Cys Xaa' | (SEQ ID NO: 3389) |
| Pro Gly Thr Cys Gly Xaa' Glu Ile Cys Ala Tyr Ala Ala Cys Thr Gly Xaa' Cys | (SEQ ID NO: 3390) |
| Pro Gly Thr Cys Gly Xaa' Glu Ile Cys Ala Tyr Ala Ala Cys Thr Gly Xaa' Cys Xaa' | (SEQ ID NO: 3391) |
| Pro Gly Thr Cys Gly Xaa' Glu Ile Cys Ala Tyr Ala Ala Cys Thr Gly Xaa' Xaa' Cys | (SEQ ID NO: 3392) |
| Pro Gly Thr Cys Gly Xaa' Glu Ile Cys Ala Tyr Ala Ala Cys Thr Gly Xaa' Xaa' Xaa' Cys | (SEQ ID NO: 3393) |
| Pro Gly Thr Cys Gly Xaa' Glu Ile Cys Ala Tyr Ala Ala Cys Thr Gly Xaa' Xaa' Cys Xaa' | (SEQ ID NO: 3394) |
| Pro Gly Thr Cys Gly Xaa' Glu Ile Cys Ala Tyr Ala Ala Cys Thr Gly Cys Xaa' | (SEQ ID NO: 3395) |
| Pro Gly Thr Cys Gly Xaa' Glu Ile Cys Ala Tyr Ala Ala Cys Thr Gly Cys Xaa' Xaa' | (SEQ ID NO: 3396) |
| Pro Gly Thr Cys Gly Xaa' Glu Ile Cys Ala Tyr Ala Ala Cys Thr Gly Cys Xaa' | (SEQ ID NO: 3397) |
| Pro Gly Thr Cys Gly Xaa' Glu Ile Cys Ala Tyr Ala Ala Cys Thr Gly Cys Xaa' Xaa' | (SEQ ID NO: 3398) |
| Pro Gly Thr Cys Gly Xaa' Glu Ile Cys Ala Tyr Ala Ala Cys Thr Gly Xaa' Cys Xaa' Xaa' | (SEQ ID NO: 3399) |
| Pro Gly Thr Cys Gly Glu Xaa' Ile Cys Ala Tyr Ala Ala Cys Thr Gly Cys | (SEQ ID NO: 3400) |
| Pro Gly Thr Cys Gly Glu Xaa' Ile Cys Ala Tyr Ala Ala Cys Ala Thr Gly Cys | (SEQ ID NO: 3401) |
| Pro Gly Thr Cys Gly Glu Xaa' Xaa' Ile Cys Ala Tyr Ala Ala Cys Ala Thr Gly Cys | (SEQ ID NO: 3402) |
| Pro Gly Thr Cys Gly Glu Xaa' Xaa' Xaa' Ile Cys Ala Tyr Ala Ala Cys Ala Thr Gly Cys | (SEQ ID NO: 3403) |
| Pro Gly Thr Cys Gly Glu Xaa' Xaa' Xaa' Xaa' Ile Xaa' Cys Ala Tyr Ala Ala Cys Thr Gly Cys | (SEQ ID NO: 3404) |

FIG. 2

| | | | | | | | | | | | | | | | | |
|---|---|---|---|---|---|---|---|---|---|---|---|---|---|---|---|---|
| Pro Gly Thr Cys Gly Glu Xaa' Xaa' Ile Cys Xaa' Ala Tyr Ala Ala Cys Thr Gly Cys | (SEQ ID NO: 3405) |
| Pro Gly Thr Cys Gly Glu Xaa' Xaa' Ile Cys Ala Xaa' Tyr Ala Ala Cys Thr Gly Cys | (SEQ ID NO: 3406) |
| Pro Gly Thr Cys Gly Glu Xaa' Xaa' Ile Cys Ala Tyr Xaa' Ala Ala Cys Thr Gly Cys | (SEQ ID NO: 3407) |
| Pro Gly Thr Cys Gly Glu Xaa' Xaa' Ile Cys Ala Tyr Ala Xaa' Ala Cys Thr Gly Cys | (SEQ ID NO: 3408) |
| Pro Gly Thr Cys Gly Glu Xaa' Xaa' Ile Cys Ala Tyr Ala Ala Xaa' Cys Thr Gly Cys | (SEQ ID NO: 3409) |
| Pro Gly Thr Cys Gly Glu Xaa' Xaa' Ile Cys Ala Tyr Ala Ala Cys Xaa' Thr Gly Cys | (SEQ ID NO: 3410) |
| Pro Gly Thr Cys Gly Glu Xaa' Xaa' Ile Cys Ala Tyr Ala Ala Cys Thr Xaa' Gly Cys | (SEQ ID NO: 3411) |
| Pro Gly Thr Cys Gly Glu Xaa' Xaa' Ile Cys Ala Tyr Ala Ala Cys Thr Gly Xaa' Cys | (SEQ ID NO: 3412) |
| Pro Gly Thr Cys Gly Glu Xaa' Xaa' Ile Cys Ala Tyr Ala Ala Cys Thr Gly Cys Xaa' | (SEQ ID NO: 3413) |
| Pro Gly Thr Cys Gly Glu Xaa' Ile Xaa' Cys Ala Tyr Ala Ala Cys Thr Gly Cys | (SEQ ID NO: 3414) |
| Pro Gly Thr Cys Gly Glu Xaa' Ile Xaa' Cys Xaa' Ala Tyr Ala Ala Cys Thr Gly Cys | (SEQ ID NO: 3415) |
| Pro Gly Thr Cys Gly Glu Xaa' Ile Xaa' Cys Ala Xaa' Tyr Ala Ala Cys Thr Gly Cys | (SEQ ID NO: 3416) |
| Pro Gly Thr Cys Gly Glu Xaa' Ile Xaa' Cys Ala Tyr Xaa' Ala Ala Cys Thr Gly Cys | (SEQ ID NO: 3417) |
| Pro Gly Thr Cys Gly Glu Xaa' Ile Xaa' Cys Ala Tyr Ala Xaa' Ala Cys Thr Gly Cys | (SEQ ID NO: 3418) |
| Pro Gly Thr Cys Gly Glu Xaa' Ile Xaa' Cys Ala Tyr Ala Ala Xaa' Cys Thr Gly Cys | (SEQ ID NO: 3419) |
| Pro Gly Thr Cys Gly Glu Xaa' Ile Xaa' Cys Ala Tyr Ala Ala Cys Xaa' Thr Gly Cys | (SEQ ID NO: 3420) |
| Pro Gly Thr Cys Gly Glu Xaa' Ile Xaa' Cys Ala Tyr Ala Ala Cys Thr Xaa' Gly Cys | (SEQ ID NO: 3421) |
| Pro Gly Thr Cys Gly Glu Xaa' Ile Xaa' Cys Ala Tyr Ala Ala Cys Thr Gly Xaa' Cys | (SEQ ID NO: 3422) |
| Pro Gly Thr Cys Gly Glu Xaa' Ile Xaa' Cys Ala Tyr Ala Ala Cys Thr Gly Cys Xaa' | (SEQ ID NO: 3423) |
| Pro Gly Thr Cys Gly Glu Xaa' Ile Cys Xaa' Ala Tyr Ala Ala Cys Thr Gly Cys | (SEQ ID NO: 3424) |
| Pro Gly Thr Cys Gly Glu Xaa' Ile Cys Xaa' Ala Tyr Ala Ala Cys Thr Gly Cys | (SEQ ID NO: 3425) |
| Pro Gly Thr Cys Gly Glu Xaa' Ile Cys Xaa' Ala Xaa' Tyr Ala Ala Cys Thr Gly Cys | (SEQ ID NO: 3426) |
| Pro Gly Thr Cys Gly Glu Xaa' Ile Cys Xaa' Ala Tyr Xaa' Ala Ala Cys Thr Gly Cys | (SEQ ID NO: 3427) |
| Pro Gly Thr Cys Gly Glu Xaa' Ile Cys Xaa' Ala Tyr Ala Xaa' Ala Cys Thr Gly Cys | (SEQ ID NO: 3428) |
| Pro Gly Thr Cys Gly Glu Xaa' Ile Cys Xaa' Ala Tyr Ala Ala Xaa' Cys Thr Gly Cys | (SEQ ID NO: 3429) |
| Pro Gly Thr Cys Gly Glu Xaa' Ile Cys Xaa' Ala Tyr Ala Ala Cys Xaa' Thr Gly Cys | (SEQ ID NO: 3430) |
| Pro Gly Thr Cys Gly Glu Xaa' Ile Cys Xaa' Ala Tyr Ala Ala Cys Thr Xaa' Gly Cys | (SEQ ID NO: 3431) |
| Pro Gly Thr Cys Gly Glu Xaa' Ile Cys Xaa' Ala Tyr Ala Ala Cys Thr Gly Xaa' Cys | (SEQ ID NO: 3432) |
| Pro Gly Thr Cys Gly Glu Xaa' Ile Cys Xaa' Ala Tyr Ala Ala Cys Thr Gly Cys Xaa' | (SEQ ID NO: 3433) |
| Pro Gly Thr Cys Gly Glu Xaa' Ile Cys Ala Xaa' Tyr Ala Ala Cys Thr Gly Cys | (SEQ ID NO: 3434) |
| Pro Gly Thr Cys Gly Glu Xaa' Ile Cys Ala Xaa' Tyr Ala Ala Cys Thr Gly Cys | (SEQ ID NO: 3435) |
| Pro Gly Thr Cys Gly Glu Xaa' Ile Cys Ala Xaa' Tyr Xaa' Ala Ala Cys Thr Gly Cys | (SEQ ID NO: 3436) |
| Pro Gly Thr Cys Gly Glu Xaa' Ile Cys Ala Xaa' Tyr Ala Xaa' Ala Cys Thr Gly Cys | (SEQ ID NO: 3437) |
| Pro Gly Thr Cys Gly Glu Xaa' Ile Cys Ala Xaa' Tyr Ala Ala Xaa' Cys Thr Gly Cys | (SEQ ID NO: 3438) |

FIG. 2

| | | | | | | | | | | | |
|---|---|---|---|---|---|---|---|---|---|---|---|
| Pro | Gly | Thr | Cys | Gly | Glu | Xaa | Xaa' | Ile | Cys | Ala | Xaa' | Tyr | Ala | Ala | Xaa' | Cys | Thr | Gly | Cys | (SEQ ID NO: 3439) |
| Pro | Gly | Thr | Cys | Gly | Glu | Xaa | Xaa' | Ile | Cys | Ala | Xaa' | Tyr | Ala | Ala | Cys | Xaa' | Thr | Gly | Cys | (SEQ ID NO: 3440) |
| Pro | Gly | Thr | Cys | Gly | Glu | Xaa | Xaa' | Ile | Cys | Ala | Xaa' | Tyr | Ala | Ala | Cys | Thr | Xaa' | Gly | Cys | (SEQ ID NO: 3441) |
| Pro | Gly | Thr | Cys | Gly | Glu | Xaa | Xaa' | Ile | Cys | Ala | Xaa' | Tyr | Ala | Ala | Cys | Thr | Gly | Xaa' | Cys | (SEQ ID NO: 3442) |
| Pro | Gly | Thr | Cys | Gly | Glu | Xaa | Xaa' | Ile | Cys | Ala | Xaa' | Tyr | Ala | Ala | Cys | Thr | Gly | Cys | Xaa' | (SEQ ID NO: 3443) |
| Pro | Gly | Thr | Cys | Gly | Glu | Xaa | Xaa' | Ile | Cys | Ala | Tyr | Xaa' | Ala | Ala | Cys | Thr | Gly | Cys | | (SEQ ID NO: 3444) |
| Pro | Gly | Thr | Cys | Gly | Glu | Xaa | Xaa' | Ile | Cys | Ala | Tyr | Xaa' | Ala | Ala | Cys | Thr | Gly | Cys | | (SEQ ID NO: 3445) |
| Pro | Gly | Thr | Cys | Gly | Glu | Xaa | Xaa' | Ile | Cys | Ala | Tyr | Xaa' | Ala | Ala | Cys | Thr | Gly | Cys | | (SEQ ID NO: 3446) |
| Pro | Gly | Thr | Cys | Gly | Glu | Xaa | Xaa' | Ile | Cys | Ala | Tyr | Xaa' | Ala | Ala | Xaa' | Cys | Thr | Gly | Cys | (SEQ ID NO: 3447) |
| Pro | Gly | Thr | Cys | Gly | Glu | Xaa | Xaa' | Ile | Cys | Ala | Tyr | Xaa' | Ala | Ala | Cys | Xaa' | Thr | Gly | Cys | (SEQ ID NO: 3448) |
| Pro | Gly | Thr | Cys | Gly | Glu | Xaa | Xaa' | Ile | Cys | Ala | Tyr | Xaa' | Ala | Ala | Cys | Thr | Xaa' | Gly | Cys | (SEQ ID NO: 3449) |
| Pro | Gly | Thr | Cys | Gly | Glu | Xaa | Xaa' | Ile | Cys | Ala | Tyr | Xaa' | Ala | Ala | Cys | Thr | Gly | Xaa' | Cys | (SEQ ID NO: 3450) |
| Pro | Gly | Thr | Cys | Gly | Glu | Xaa | Xaa' | Ile | Cys | Ala | Tyr | Xaa' | Ala | Ala | Cys | Thr | Gly | Cys | Xaa' | (SEQ ID NO: 3451) |
| Pro | Gly | Thr | Cys | Gly | Glu | Xaa | Xaa' | Ile | Cys | Ala | Tyr | Ala | Xaa' | Ala | Cys | Thr | Gly | Cys | | (SEQ ID NO: 3452) |
| Pro | Gly | Thr | Cys | Gly | Glu | Xaa | Xaa' | Ile | Cys | Ala | Tyr | Ala | Xaa' | Ala | Xaa' | Cys | Thr | Gly | Cys | (SEQ ID NO: 3453) |
| Pro | Gly | Thr | Cys | Gly | Glu | Xaa | Xaa' | Ile | Cys | Ala | Tyr | Ala | Xaa' | Ala | Cys | Xaa' | Thr | Gly | Cys | (SEQ ID NO: 3454) |
| Pro | Gly | Thr | Cys | Gly | Glu | Xaa | Xaa' | Ile | Cys | Ala | Tyr | Ala | Xaa' | Ala | Cys | Thr | Xaa' | Gly | Cys | (SEQ ID NO: 3455) |
| Pro | Gly | Thr | Cys | Gly | Glu | Xaa | Xaa' | Ile | Cys | Ala | Tyr | Ala | Xaa' | Ala | Cys | Thr | Gly | Xaa' | Cys | (SEQ ID NO: 3456) |
| Pro | Gly | Thr | Cys | Gly | Glu | Xaa | Xaa' | Ile | Cys | Ala | Tyr | Ala | Xaa' | Ala | Cys | Thr | Gly | Cys | Xaa' | (SEQ ID NO: 3457) |
| Pro | Gly | Thr | Cys | Gly | Glu | Xaa | Xaa' | Ile | Cys | Ala | Tyr | Ala | Ala | Xaa' | Cys | Thr | Gly | Cys | | (SEQ ID NO: 3458) |
| Pro | Gly | Thr | Cys | Gly | Glu | Xaa | Xaa' | Ile | Cys | Ala | Tyr | Ala | Ala | Xaa' | Xaa' | Cys | Thr | Gly | Cys | (SEQ ID NO: 3459) |
| Pro | Gly | Thr | Cys | Gly | Glu | Xaa | Xaa' | Ile | Cys | Ala | Tyr | Ala | Ala | Xaa' | Cys | Xaa' | Thr | Gly | Cys | (SEQ ID NO: 3460) |
| Pro | Gly | Thr | Cys | Gly | Glu | Xaa | Xaa' | Ile | Cys | Ala | Tyr | Ala | Ala | Xaa' | Cys | Thr | Xaa' | Gly | Cys | (SEQ ID NO: 3461) |
| Pro | Gly | Thr | Cys | Gly | Glu | Xaa | Xaa' | Ile | Cys | Ala | Tyr | Ala | Ala | Xaa' | Cys | Thr | Gly | Xaa' | Cys | (SEQ ID NO: 3462) |
| Pro | Gly | Thr | Cys | Gly | Glu | Xaa | Xaa' | Ile | Cys | Ala | Tyr | Ala | Ala | Xaa' | Cys | Thr | Gly | Cys | Xaa' | (SEQ ID NO: 3463) |
| Pro | Gly | Thr | Cys | Gly | Glu | Xaa | Xaa' | Ile | Cys | Ala | Tyr | Ala | Ala | Ala | Xaa' | Cys | Thr | Gly | Cys | (SEQ ID NO: 3464) |
| Pro | Gly | Thr | Cys | Gly | Glu | Xaa | Xaa' | Ile | Cys | Ala | Tyr | Ala | Ala | Ala | Cys | Xaa' | Thr | Gly | Cys | (SEQ ID NO: 3465) |
| Pro | Gly | Thr | Cys | Gly | Glu | Xaa | Xaa' | Ile | Cys | Ala | Tyr | Ala | Ala | Ala | Cys | Xaa' | Thr | Gly | Cys | (SEQ ID NO: 3466) |
| Pro | Gly | Thr | Cys | Gly | Glu | Xaa | Xaa' | Ile | Cys | Ala | Tyr | Ala | Ala | Ala | Cys | Thr | Xaa' | Gly | Cys | (SEQ ID NO: 3467) |
| Pro | Gly | Thr | Cys | Gly | Glu | Xaa | Xaa' | Ile | Cys | Ala | Tyr | Ala | Ala | Ala | Cys | Thr | Gly | Xaa' | Cys | (SEQ ID NO: 3468) |
| Pro | Gly | Thr | Cys | Gly | Glu | Xaa | Xaa' | Ile | Cys | Ala | Tyr | Ala | Ala | Ala | Cys | Thr | Gly | Cys | Xaa' | (SEQ ID NO: 3469) |
| Pro | Gly | Thr | Cys | Gly | Glu | Xaa | Xaa' | Ile | Cys | Ala | Tyr | Ala | Ala | Ala | Cys | Thr | Ala | Gly | Cys | (SEQ ID NO: 3470) |
| Pro | Gly | Thr | Cys | Gly | Glu | Xaa | Xaa' | Ile | Cys | Ala | Tyr | Ala | Ala | Ala | Cys | Thr | Xaa' | Gly | Cys | (SEQ ID NO: 3471) |
|

| | | | | | | | | | | | | | |
|---|---|---|---|---|---|---|---|---|---|---|---|---|---|
|Pro Gly Thr Cys Gly Glu Xaa' Xaa' Ile Cys Ala Tyr Ala Ala Cys Thr Xaa' Gly Cys Xaa'|(SEQ ID NO: 3473)|
|Pro Gly Thr Cys Gly Glu Xaa' Xaa' Ile Cys Ala Tyr Ala Ala Cys Thr Gly Xaa' Cys|(SEQ ID NO: 3474)|
|Pro Gly Thr Cys Gly Glu Xaa' Xaa' Ile Cys Ala Tyr Ala Ala Cys Thr Gly Xaa' Xaa' Cys|(SEQ ID NO: 3475)|
|Pro Gly Thr Cys Gly Glu Xaa' Xaa' Ile Cys Ala Tyr Ala Ala Cys Thr Gly Xaa' Cys Xaa'|(SEQ ID NO: 3476)|
|Pro Gly Thr Cys Gly Glu Xaa' Xaa' Ile Cys Ala Tyr Ala Ala Cys Thr Gly Cys Xaa'|(SEQ ID NO: 3477)|
|Pro Gly Thr Cys Gly Glu Xaa' Xaa' Ile Cys Ala Tyr Ala Ala Cys Thr Gly Cys Xaa' Xaa'|(SEQ ID NO: 3478)|
|Pro Gly Thr Cys Gly Glu Xaa' Ile Xaa' Cys Ala Tyr Ala Ala Cys Thr Gly Cys|(SEQ ID NO: 3479)|
|Pro Gly Thr Cys Gly Glu Xaa' Ile Xaa' Cys Xaa' Cys Ala Tyr Ala Ala Cys Thr Gly Cys|(SEQ ID NO: 3480)|
|Pro Gly Thr Cys Gly Glu Xaa' Ile Xaa' Cys Xaa' Xaa' Cys Ala Tyr Ala Ala Cys Thr Gly Cys|(SEQ ID NO: 3481)|
|Pro Gly Thr Cys Gly Glu Xaa' Ile Xaa' Cys Xaa' Cys Ala Tyr Xaa' Ala Ala Cys Thr Gly Cys|(SEQ ID NO: 3482)|
|Pro Gly Thr Cys Gly Glu Xaa' Ile Xaa' Cys Xaa' Xaa' Tyr Ala Ala Cys Thr Gly Cys|(SEQ ID NO: 3483)|
|Pro Gly Thr Cys Gly Glu Xaa' Ile Xaa' Cys Xaa' Cys Ala Tyr Xaa' Ala Ala Cys Thr Gly Cys|(SEQ ID NO: 3484)|
|Pro Gly Thr Cys Gly Glu Xaa' Ile Xaa' Cys Xaa' Cys Ala Tyr Xaa' Xaa' Ala Cys Thr Gly Cys|(SEQ ID NO: 3485)|
|Pro Gly Thr Cys Gly Glu Xaa' Ile Xaa' Cys Xaa' Cys Ala Tyr Xaa' Ala Cys Xaa' Thr Gly Cys|(SEQ ID NO: 3486)|
|Pro Gly Thr Cys Gly Glu Xaa' Ile Xaa' Cys Xaa' Cys Ala Tyr Xaa' Ala Cys Thr Gly Cys|(SEQ ID NO: 3487)|
|Pro Gly Thr Cys Gly Glu Xaa' Ile Xaa' Cys Xaa' Cys Ala Tyr Xaa' Ala Ala Cys Xaa' Thr Gly Cys|(SEQ ID NO: 3488)|
|Pro Gly Thr Cys Gly Glu Xaa' Ile Xaa' Cys Xaa' Cys Ala Tyr Xaa' Ala Ala Cys Thr Gly Xaa' Cys|(SEQ ID NO: 3489)|
|Pro Gly Thr Cys Gly Glu Xaa' Ile Xaa' Cys Xaa' Cys Ala Tyr Xaa' Ala Ala Cys Thr Gly Cys Xaa'|(SEQ ID NO: 3490)|
|Pro Gly Thr Cys Gly Glu Xaa' Ile Xaa' Cys Xaa' Cys Xaa' Ala Ala Ala Cys Thr Gly Cys|(SEQ ID NO: 3491)|
|Pro Gly Thr Cys Gly Glu Xaa' Ile Xaa' Cys Xaa' Cys Xaa' Ala Tyr Ala Ala Ala Cys Thr Gly Cys|(SEQ ID NO: 3492)|
|Pro Gly Thr Cys Gly Glu Xaa' Ile Xaa' Cys Xaa' Cys Xaa' Ala Tyr Ala Xaa' Ala Cys Thr Gly Cys|(SEQ ID NO: 3493)|
|Pro Gly Thr Cys Gly Glu Xaa' Ile Xaa' Cys Xaa' Cys Xaa' Ala Tyr Ala Xaa' Ala Cys Thr Gly Cys|(SEQ ID NO: 3494)|
|Pro Gly Thr Cys Gly Glu Xaa' Ile Xaa' Cys Xaa' Cys Xaa' Ala Tyr Ala Ala Cys Thr Gly Cys|(SEQ ID NO: 3495)|
|Pro Gly Thr Cys Gly Glu Xaa' Ile Xaa' Cys Xaa' Cys Xaa' Ala Tyr Ala Ala Xaa' Cys Thr Gly Cys|(SEQ ID NO: 3496)|
|Pro Gly Thr Cys Gly Glu Xaa' Ile Xaa' Cys Xaa' Cys Xaa' Ala Tyr Ala Ala Cys Xaa' Thr Gly Cys|(SEQ ID NO: 3497)|
|Pro Gly Thr Cys Gly Glu Xaa' Ile Xaa' Cys Xaa' Cys Xaa' Ala Tyr Ala Ala Cys Thr Xaa' Gly Cys|(SEQ ID NO: 3498)|
|Pro Gly Thr Cys Gly Glu Xaa' Ile Xaa' Cys Xaa' Cys Xaa' Ala Tyr Ala Ala Cys Thr Gly Xaa' Cys|(SEQ ID NO: 3499)|
|Pro Gly Thr Cys Gly Glu Xaa' Ile Xaa' Cys Xaa' Cys Xaa' Ala Tyr Ala Ala Cys Thr Gly Cys Xaa'|(SEQ ID NO: 3500)|
|Pro Gly Thr Cys Gly Glu Xaa' Ile Xaa' Cys Ala Cys Xaa' Ala Tyr Ala Ala Cys Thr Gly Cys|(SEQ ID NO: 3501)|
|Pro Gly Thr Cys Gly Glu Xaa' Ile Xaa' Cys Ala Cys Xaa' Xaa' Tyr Ala Ala Cys Thr Gly Cys|(SEQ ID NO: 3502)|
|Pro Gly Thr Cys Gly Glu Xaa' Ile Xaa' Cys Ala Cys Xaa' Tyr Xaa' Ala Ala Cys Thr Gly Cys|(SEQ ID NO: 3503)|
|Pro Gly Thr Cys Gly Glu Xaa' Ile Xaa' Cys Ala Cys Xaa' Tyr Ala Xaa' Ala Cys Thr Gly Cys|(SEQ ID NO: 3504)|
|Pro Gly Thr Cys Gly Glu Xaa' Ile Xaa' Cys Ala Cys Xaa' Tyr Ala Ala Xaa' Cys Thr Gly Cys|(SEQ ID NO: 3505)|
|Pro Gly Thr Cys Gly Glu Xaa' Ile Xaa' Cys Ala Cys Xaa' Tyr Ala Ala Cys Xaa' Thr Gly Cys|(SEQ ID NO: 3506)|

FIG. 2

| | | | | | | | | | | | | |
|---|---|---|---|---|---|---|---|---|---|---|---|---|
| Pro | Gly | Thr | Cys | Gly | Glu | Xaa' | Ile | Xaa' | Cys | Ala | Xaa' | Tyr | Ala | Ala | Cys | Thr | Xaa' | Gly | Cys | (SEQ ID NO: 3507) |
| Pro | Gly | Thr | Cys | Gly | Glu | Xaa' | Ile | Xaa' | Cys | Ala | Xaa' | Tyr | Ala | Ala | Cys | Thr | Gly | Xaa' | Cys | (SEQ ID NO: 3508) |
| Pro | Gly | Thr | Cys | Gly | Glu | Xaa' | Ile | Xaa' | Cys | Ala | Xaa' | Tyr | Ala | Ala | Cys | Thr | Gly | Cys | Xaa' | (SEQ ID NO: 3509) |
| Pro | Gly | Thr | Cys | Gly | Glu | Xaa' | Ile | Xaa' | Cys | Ala | Xaa' | Tyr | Ala | Ala | Cys | Xaa' | Thr | Gly | Cys | (SEQ ID NO: 3510) |
| Pro | Gly | Thr | Cys | Gly | Glu | Xaa' | Ile | Xaa' | Cys | Ala | Xaa' | Tyr | Xaa' | Ala | Cys | Thr | Ala | Gly | Cys | (SEQ ID NO: 3511) |
| Pro | Gly | Thr | Cys | Gly | Glu | Xaa' | Ile | Xaa' | Cys | Ala | Xaa' | Tyr | Xaa' | Ala | Ala | Cys | Thr | Gly | Cys | (SEQ ID NO: 3512) |
| Pro | Gly | Thr | Cys | Gly | Glu | Xaa' | Ile | Xaa' | Cys | Ala | Xaa' | Xaa' | Ala | Ala | Cys | Thr | Thr | Gly | Cys | (SEQ ID NO: 3513) |
| Pro | Gly | Thr | Cys | Gly | Glu | Xaa' | Ile | Xaa' | Cys | Ala | Xaa' | Xaa' | Ala | Ala | Xaa' | Cys | Thr | Gly | Cys | (SEQ ID NO: 3514) |
| Pro | Gly | Thr | Cys | Gly | Glu | Xaa' | Ile | Xaa' | Cys | Ala | Xaa' | Tyr | Ala | Ala | Cys | Xaa' | Thr | Gly | Cys | (SEQ ID NO: 3515) |
| Pro | Gly | Thr | Cys | Gly | Glu | Xaa' | Ile | Xaa' | Cys | Ala | Xaa' | Tyr | Ala | Ala | Cys | Thr | Gly | Xaa' | Cys | (SEQ ID NO: 3516) |
| Pro | Gly | Thr | Cys | Gly | Glu | Xaa' | Ile | Xaa' | Cys | Ala | Xaa' | Tyr | Ala | Ala | Cys | Thr | Gly | Cys | Xaa' | (SEQ ID NO: 3517) |
| Pro | Gly | Thr | Cys | Gly | Glu | Xaa' | Ile | Xaa' | Cys | Ala | Xaa' | Ala | Xaa' | Ala | Cys | Thr | Gly | Cys | | (SEQ ID NO: 3518) |
| Pro | Gly | Thr | Cys | Gly | Glu | Xaa' | Ile | Xaa' | Cys | Ala | Tyr | Ala | Xaa' | Ala | Cys | Thr | Gly | Cys | | (SEQ ID NO: 3519) |
| Pro | Gly | Thr | Cys | Gly | Glu | Xaa' | Ile | Xaa' | Cys | Ala | Tyr | Ala | Xaa' | Ala | Xaa' | Cys | Thr | Gly | Cys | (SEQ ID NO: 3520) |
| Pro | Gly | Thr | Cys | Gly | Glu | Xaa' | Ile | Xaa' | Cys | Ala | Tyr | Ala | Xaa' | Ala | Cys | Xaa' | Thr | Gly | Cys | (SEQ ID NO: 3521) |
| Pro | Gly | Thr | Cys | Gly | Glu | Xaa' | Ile | Xaa' | Cys | Ala | Tyr | Ala | Xaa' | Ala | Cys | Thr | Xaa' | Gly | Cys | (SEQ ID NO: 3522) |
| Pro | Gly | Thr | Cys | Gly | Glu | Xaa' | Ile | Xaa' | Cys | Ala | Tyr | Ala | Xaa' | Ala | Cys | Thr | Gly | Xaa' | Cys | (SEQ ID NO: 3523) |
| Pro | Gly | Thr | Cys | Gly | Glu | Xaa' | Ile | Xaa' | Cys | Ala | Tyr | Ala | Xaa' | Ala | Cys | Thr | Gly | Cys | Xaa' | (SEQ ID NO: 3524) |
| Pro | Gly | Thr | Cys | Gly | Glu | Xaa' | Ile | Xaa' | Cys | Ala | Tyr | Ala | Ala | Xaa' | Cys | Thr | Gly | Cys | | (SEQ ID NO: 3525) |
| Pro | Gly | Thr | Cys | Gly | Glu | Xaa' | Ile | Xaa' | Cys | Ala | Tyr | Ala | Ala | Xaa' | Cys | Thr | Gly | Cys | | (SEQ ID NO: 3526) |
| Pro | Gly | Thr | Cys | Gly | Glu | Xaa' | Ile | Xaa' | Cys | Ala | Tyr | Ala | Ala | Xaa' | Cys | Xaa' | Thr | Gly | Cys | (SEQ ID NO: 3527) |
| Pro | Gly | Thr | Cys | Gly | Glu | Xaa' | Ile | Xaa' | Cys | Ala | Tyr | Ala | Ala | Xaa' | Cys | Thr | Xaa' | Gly | Cys | (SEQ ID NO: 3528) |
| Pro | Gly | Thr | Cys | Gly | Glu | Xaa' | Ile | Xaa' | Cys | Ala | Tyr | Ala | Ala | Xaa' | Cys | Thr | Gly | Xaa' | Cys | (SEQ ID NO: 3529) |
| Pro | Gly | Thr | Cys | Gly | Glu | Xaa' | Ile | Xaa' | Cys | Ala | Tyr | Ala | Ala | Xaa' | Cys | Thr | Gly | Cys | Xaa' | (SEQ ID NO: 3530) |
| Pro | Gly | Thr | Cys | Gly | Glu | Xaa' | Ile | Xaa' | Cys | Ala | Tyr | Ala | Ala | Ala | Xaa' | Cys | Thr | Gly | Cys | (SEQ ID NO: 3531) |
| Pro | Gly | Thr | Cys | Gly | Glu | Xaa' | Ile | Xaa' | Cys | Ala | Tyr | Ala | Ala | Ala | Xaa' | Thr | Xaa' | Gly | Cys | (SEQ ID NO: 3532) |
| Pro | Gly | Thr | Cys | Gly | Glu | Xaa' | Ile | Xaa' | Cys | Ala | Tyr | Ala | Ala | Ala | Cys | Xaa' | Thr | Gly | Cys | (SEQ ID NO: 3533) |
| Pro | Gly | Thr | Cys | Gly | Glu | Xaa' | Ile | Xaa' | Cys | Ala | Tyr | Ala | Ala | Ala | Cys | Thr | Xaa' | Gly | Cys | (SEQ ID NO: 3534) |
| Pro | Gly | Thr | Cys | Gly | Glu | Xaa' | Ile | Xaa' | Cys | Ala | Tyr | Ala | Ala | Ala | Cys | Thr | Gly | Xaa' | Cys | (SEQ ID NO: 3535) |
| Pro | Gly | Thr | Cys | Gly | Glu | Xaa' | Ile | Xaa' | Cys | Ala | Tyr | Ala | Ala | Ala | Cys | Thr | Gly | Cys | Xaa' | (SEQ ID NO: 3536) |
| Pro | Gly | Thr | Cys | Gly | Glu | Xaa' | Ile | Xaa' | Cys | Ala | Tyr | Ala | Ala | Ala | Cys | Thr | Xaa' | Gly | Cys | (SEQ ID NO: 3537) |
| Pro | Gly | Thr | Cys | Gly | Glu | Xaa' | Ile | Xaa' | Cys | Ala | Tyr | Ala | Ala | Ala | Cys | Thr | Gly | Xaa' | Cys | (SEQ ID NO: 3538) |
| Pro | Gly | Thr | Cys | Gly | Glu | Xaa' | Ile | Xaa' | Cys | Ala | Tyr | Ala | Ala | Ala | Cys | Thr | Gly | Cys | Xaa' | (SEQ ID NO: 3539) |
| Pro | Gly | Thr | Cys | Gly | Glu | Xaa' | Ile | Xaa' | Cys | Ala | Tyr | Ala | Ala | Ala | Cys | Thr | Gly | Cys | | (SEQ ID NO: 3540) |

FIG. 2

```
Pro Gly Thr Cys Gly Glu Xaa' Ile Xaa' Cys Ala Tyr Ala Ala Cys Thr Gly Xaa' Xaa' Cys       (SEQID NO: 3541)
Pro Gly Thr Cys Gly Glu Xaa' Ile Xaa' Cys Ala Tyr Ala Ala Cys Thr Gly Xaa' Cys Xaa'       (SEQID NO: 3542)
Pro Gly Thr Cys Gly Glu Xaa' Ile Xaa' Cys Ala Tyr Ala Ala Cys Thr Gly Cys Xaa'            (SEQID NO: 3543)
Pro Gly Thr Cys Gly Glu Xaa' Ile Xaa' Cys Ala Tyr Ala Ala Cys Thr Gly Cys Xaa' Xaa'       (SEQID NO: 3544)
Pro Gly Thr Cys Gly Glu Xaa' Ile Cys Xaa' Ala Tyr Ala Ala Cys Thr Gly Cys                 (SEQID NO: 3545)
Pro Gly Thr Cys Gly Glu Xaa' Ile Cys Xaa' Xaa' Ala Tyr Ala Ala Cys Thr Gly Cys            (SEQID NO: 3546)
Pro Gly Thr Cys Gly Glu Xaa' Ile Cys Xaa' Xaa' Ala Tyr Ala Xaa' Ala Cys Thr Gly Cys       (SEQID NO: 3547)
Pro Gly Thr Cys Gly Glu Xaa' Ile Cys Xaa' Xaa' Ala Tyr Xaa' Ala Ala Cys Thr Gly Cys       (SEQID NO: 3548)
Pro Gly Thr Cys Gly Glu Xaa' Ile Cys Xaa' Xaa' Ala Xaa' Tyr Ala Ala Cys Thr Gly Cys       (SEQID NO: 3549)
Pro Gly Thr Cys Gly Glu Xaa' Ile Cys Xaa' Xaa' Xaa' Ala Tyr Ala Ala Cys Thr Gly Cys       (SEQID NO: 3550)
Pro Gly Thr Cys Gly Glu Xaa' Ile Cys Xaa' Xaa' Ala Tyr Ala Ala Xaa' Cys Thr Gly Cys       (SEQID NO: 3551)
Pro Gly Thr Cys Gly Glu Xaa' Ile Cys Xaa' Xaa' Ala Tyr Ala Ala Cys Xaa' Thr Gly Cys       (SEQID NO: 3552)
Pro Gly Thr Cys Gly Glu Xaa' Ile Cys Xaa' Xaa' Ala Tyr Ala Ala Cys Thr Xaa' Gly Cys       (SEQID NO: 3553)
Pro Gly Thr Cys Gly Glu Xaa' Ile Cys Xaa' Xaa' Ala Tyr Ala Ala Cys Thr Gly Xaa' Cys       (SEQID NO: 3554)
Pro Gly Thr Cys Gly Glu Xaa' Ile Cys Xaa' Xaa' Ala Tyr Ala Ala Cys Thr Gly Cys Xaa'       (SEQID NO: 3555)
Pro Gly Thr Cys Gly Glu Xaa' Ile Cys Xaa' Ala Xaa' Tyr Ala Ala Cys Thr Gly Cys            (SEQID NO: 3556)
Pro Gly Thr Cys Gly Glu Xaa' Ile Cys Xaa' Ala Xaa' Tyr Ala Ala Xaa' Ala Cys Thr Gly Cys   (SEQID NO: 3557)
Pro Gly Thr Cys Gly Glu Xaa' Ile Cys Xaa' Ala Xaa' Tyr Ala Xaa' Ala Cys Thr Gly Cys       (SEQID NO: 3558)
Pro Gly Thr Cys Gly Glu Xaa' Ile Cys Xaa' Ala Xaa' Tyr Xaa' Ala Ala Cys Thr Gly Cys       (SEQID NO: 3559)
Pro Gly Thr Cys Gly Glu Xaa' Ile Cys Xaa' Ala Tyr Xaa' Ala Ala Cys Thr Gly Cys            (SEQID NO: 3560)
Pro Gly Thr Cys Gly Glu Xaa' Ile Cys Xaa' Ala Tyr Xaa' Ala Xaa' Ala Cys Thr Gly Cys       (SEQID NO: 3561)
Pro Gly Thr Cys Gly Glu Xaa' Ile Cys Xaa' Ala Tyr Ala Xaa' Ala Cys Thr Gly Cys            (SEQID NO: 3562)
Pro Gly Thr Cys Gly Glu Xaa' Ile Cys Xaa' Ala Tyr Ala Xaa' Ala Xaa' Ala Cys Thr Gly Cys   (SEQID NO: 3563)
Pro Gly Thr Cys Gly Glu Xaa' Ile Cys Xaa' Ala Tyr Ala Ala Xaa' Cys Thr Gly Cys Xaa'       (SEQID NO: 3564)
Pro Gly Thr Cys Gly Glu Xaa' Ile Cys Xaa' Ala Tyr Xaa' Ala Ala Ala Cys Thr Gly Cys        (SEQID NO: 3565)
Pro Gly Thr Cys Gly Glu Xaa' Ile Cys Xaa' Ala Tyr Xaa' Ala Xaa' Ala Ala Cys Thr Gly Cys   (SEQID NO: 3566)
Pro Gly Thr Cys Gly Glu Xaa' Ile Cys Xaa' Ala Tyr Xaa' Ala Ala Xaa' Ala Cys Thr Gly Cys   (SEQID NO: 3567)
Pro Gly Thr Cys Gly Glu Xaa' Ile Cys Xaa' Ala Tyr Xaa' Ala Ala Ala Xaa' Cys Thr Gly Cys   (SEQID NO: 3568)
Pro Gly Thr Cys Gly Glu Xaa' Ile Cys Xaa' Ala Tyr Xaa' Ala Ala Ala Cys Xaa' Thr Gly Cys   (SEQID NO: 3569)
Pro Gly Thr Cys Gly Glu Xaa' Ile Cys Xaa' Ala Tyr Xaa' Ala Ala Ala Cys Thr Xaa' Gly Cys   (SEQID NO: 3570)
Pro Gly Thr Cys Gly Glu Xaa' Ile Cys Xaa' Ala Tyr Xaa' Ala Ala Ala Cys Thr Gly Xaa' Cys   (SEQID NO: 3571)
Pro Gly Thr Cys Gly Glu Xaa' Ile Cys Xaa' Ala Tyr Ala Xaa' Ala Ala Cys Thr Gly Cys Xaa'   (SEQID NO: 3572)
Pro Gly Thr Cys Gly Glu Xaa' Ile Cys Xaa' Ala Tyr Ala Xaa' Ala Ala Cys Thr Gly Cys        (SEQID NO: 3573)
Pro Gly Thr Cys Gly Glu Xaa' Ile Cys Xaa' Ala Tyr Ala Xaa' Xaa' Ala Cys Thr Gly Cys       (SEQID NO: 3574)
```

FIG. 2

| | | | | | | | | | | |
|---|---|---|---|---|---|---|---|---|---|---|
| Pro Gly Thr Cys Gly Glu Xaa' | Ile Cys | Xaa' | Ala | Tyr | Ala | Xaa' | Ala | Xaa' | Cys Thr Gly Cys | (SEQID NO: 3575) |
| Pro Gly Thr Cys Gly Glu Xaa' | Ile Cys | Xaa' | Ala | Tyr | Ala | Xaa' | Ala | Cys | Xaa' Thr Gly Cys | (SEQID NO: 3576) |
| Pro Gly Thr Cys Gly Glu Xaa' | Ile Cys | Xaa' | Ala | Tyr | Ala | Xaa' | Ala | Cys | Thr Xaa' Gly Cys | (SEQID NO: 3577) |
| Pro Gly Thr Cys Gly Glu Xaa' | Ile Cys | Xaa' | Ala | Tyr | Ala | Xaa' | Ala | Cys | Thr Gly Xaa' Cys | (SEQID NO: 3578) |
| Pro Gly Thr Cys Gly Glu Xaa' | Ile Cys | Xaa' | Ala | Tyr | Ala | Xaa' | Ala | Cys | Thr Gly Cys Xaa' | (SEQID NO: 3579) |
| Pro Gly Thr Cys Gly Glu Xaa' | Ile Cys | Xaa' | Ala | Tyr | Ala | Xaa' | Ala | Ala | Xaa' Thr Gly Cys | (SEQID NO: 3580) |
| Pro Gly Thr Cys Gly Glu Xaa' | Ile Cys | Xaa' | Ala | Tyr | Ala | Xaa' | Ala | Ala | Cys Xaa' Gly Cys | (SEQID NO: 3581) |
| Pro Gly Thr Cys Gly Glu Xaa' | Ile Cys | Xaa' | Ala | Tyr | Ala | Xaa' | Ala | Ala | Cys Thr Xaa' Gly Cys | (SEQID NO: 3582) |
| Pro Gly Thr Cys Gly Glu Xaa' | Ile Cys | Xaa' | Ala | Tyr | Ala | Xaa' | Ala | Ala | Cys Thr Gly Xaa' Cys | (SEQID NO: 3583) |

Pro Gly Thr Cys Gly Glu Xaa' Ile Cys Ala Xaa' Xaa' Tyr Ala Ala Cys Thr Gly Cys Xaa' (SEQID NO: 3609)
Pro Gly Thr Cys Gly Glu Xaa' Ile Cys Ala Xaa' Xaa' Tyr Ala Ala Cys Thr Gly Cys (SEQID NO: 3610)
Pro Gly Thr Cys Gly Glu Xaa' Ile Cys Ala Xaa' Xaa' Tyr Xaa' Ala Ala Cys Thr Gly Cys (SEQID NO: 3611)
Pro Gly Thr Cys Gly Glu Xaa' Ile Cys Ala Xaa' Xaa' Tyr Xaa' Ala Ala Cys Thr Gly Cys (SEQID NO: 3612)
Pro Gly Thr Cys Gly Glu Xaa' Ile Cys Ala Xaa' Xaa' Tyr Xaa' Ala Xaa' Ala Cys Thr Gly Cys (SEQID NO: 3613)
Pro Gly Thr Cys Gly Glu Xaa' Ile Cys Ala Xaa' Xaa' Tyr Xaa' Ala Ala Xaa' Cys Thr Gly Cys (SEQID NO: 3614)
Pro Gly Thr Cys Gly Glu Xaa' Ile Cys Ala Xaa' Xaa' Tyr Xaa' Ala Ala Cys Xaa' Thr Gly Cys (SEQID NO: 3615)
Pro Gly Thr Cys Gly Glu Xaa' Ile Cys Ala Xaa' Xaa' Tyr Xaa' Ala Ala Cys Thr Gly Xaa' Cys (SEQID NO: 3616)
Pro Gly Thr Cys Gly Glu Xaa' Ile Cys Ala Xaa' Xaa' Tyr Xaa' Ala Ala Cys Thr Gly Cys Xaa' (SEQID NO: 3617)
Pro Gly Thr Cys Gly Glu Xaa' Ile Cys Ala Xaa' Xaa' Tyr Ala Ala Cys Thr Gly Cys (SEQID NO: 3618)
Pro Gly Thr Cys Gly Glu Xaa' Ile Cys Ala Xaa' Xaa' Tyr Ala Xaa' Ala Cys Thr Gly Cys (SEQID NO: 3619)
Pro Gly Thr Cys Gly Glu Xaa' Ile Cys Ala Xaa' Xaa' Tyr Ala Xaa' Ala Xaa' Cys Thr Gly Cys (SEQID NO: 3620)
Pro Gly Thr Cys Gly Glu Xaa' Ile Cys Ala Xaa' Xaa' Tyr Ala Xaa' Ala Cys Xaa' Thr Gly Cys (SEQID NO: 3621)
Pro Gly Thr Cys Gly Glu Xaa' Ile Cys Ala Xaa' Xaa' Tyr Ala Xaa' Ala Cys Thr Xaa' Gly Cys (SEQID NO: 3622)
Pro Gly Thr Cys Gly Glu Xaa' Ile Cys Ala Xaa' Xaa' Tyr Ala Xaa' Ala Cys Thr Gly Xaa' Cys (SEQID NO: 3623)
Pro Gly Thr Cys Gly Glu Xaa' Ile Cys Ala Xaa' Xaa' Tyr Ala Xaa' Ala Cys Thr Gly Cys Xaa' (SEQID NO: 3624)
Pro Gly Thr Cys Gly Glu Xaa' Ile Cys Ala Xaa' Xaa' Tyr Ala Ala Xaa' Cys Thr Gly Cys (SEQID NO: 3625)
Pro Gly Thr Cys Gly Glu Xaa' Ile Cys Ala Xaa' Xaa' Tyr Ala Ala Xaa' Cys Xaa' Thr Gly Cys (SEQID NO: 3626)
Pro Gly Thr Cys Gly Glu Xaa' Ile Cys Ala Xaa' Xaa' Tyr Ala Ala Xaa' Cys Thr Xaa' Gly Cys (SEQID NO: 3627)
Pro Gly Thr Cys Gly Glu Xaa' Ile Cys Ala Xaa' Xaa' Tyr Ala Ala Xaa' Cys Thr Gly Xaa' Cys (SEQID NO: 3628)
Pro Gly Thr Cys Gly Glu Xaa' Ile Cys Ala Xaa' Xaa' Tyr Ala Ala Xaa' Cys Thr Gly Cys Xaa' (SEQID NO: 3629)
Pro Gly Thr Cys Gly Glu Xaa' Ile Cys Ala Xaa' Xaa' Tyr Ala Ala Cys Xaa' Thr Gly Cys (SEQID NO: 3630)
Pro Gly Thr Cys Gly Glu Xaa' Ile Cys Ala Xaa' Xaa' Tyr Ala Ala Cys Xaa' Thr Gly Cys (SEQID NO: 3631)
Pro Gly Thr Cys Gly Glu Xaa' Ile Cys Ala Xaa' Xaa' Tyr Ala Ala Cys Xaa' Xaa' Thr Gly Cys (SEQID NO: 3632)
Pro Gly Thr Cys Gly Glu Xaa' Ile Cys Ala Xaa' Xaa' Tyr Ala Ala Cys Xaa' Thr Xaa' Gly Cys (SEQID NO: 3633)
Pro Gly Thr Cys Gly Glu Xaa' Ile Cys Ala Xaa' Xaa' Tyr Ala Ala Cys Xaa' Thr Gly Xaa' Cys (SEQID NO: 3634)
Pro Gly Thr Cys Gly Glu Xaa' Ile Cys Ala Xaa' Xaa' Tyr Ala Ala Cys Xaa' Thr Gly Cys Xaa' (SEQID NO: 3635)
Pro Gly Thr Cys Gly Glu Xaa' Ile Cys Ala Xaa' Xaa' Tyr Ala Ala Cys Thr Xaa' Gly Cys (SEQID NO: 3636)
Pro Gly Thr Cys Gly Glu Xaa' Ile Cys Ala Xaa' Xaa' Tyr Ala Ala Cys Thr Xaa' Xaa' Gly Cys (SEQID NO: 3637)
Pro Gly Thr Cys Gly Glu Xaa' Ile Cys Ala Xaa' Xaa' Tyr Ala Ala Cys Thr Xaa' Gly Xaa' Cys (SEQID NO: 3638)
Pro Gly Thr Cys Gly Glu Xaa' Ile Cys Ala Xaa' Xaa' Tyr Ala Ala Cys Thr Xaa' Gly Cys Xaa' (SEQID NO: 3639)
Pro Gly Thr Cys Gly Glu Xaa' Ile Cys Ala Xaa' Xaa' Tyr Ala Ala Cys Thr Gly Xaa' Cys (SEQID NO: 3640)
Pro Gly Thr Cys Gly Glu Xaa' Ile Cys Ala Xaa' Xaa' Tyr Ala Ala Cys Thr Gly Xaa' Xaa' Cys (SEQID NO: 3641)
Pro Gly Thr Cys Gly Glu Xaa' Ile Cys Ala Xaa' Xaa' Tyr Ala Ala Cys Thr Gly Xaa' Cys Xaa' (SEQID NO: 3642)

FIG. 2

```
Pro Gly Thr Cys Gly Glu Xaa' Ile Cys Ala Xaa' Tyr Ala Ala Cys Thr Gly Cys Xaa'  (SEQ ID NO: 3643)
Pro Gly Thr Cys Gly Glu Xaa' Ile Cys Ala Xaa' Tyr Ala Ala Cys Thr Gly Cys Xaa'  (SEQ ID NO: 3644)
Pro Gly Thr Cys Gly Glu Xaa' Ile Cys Ala Xaa' Tyr Ala Ala Cys Thr Gly Cys       (SEQ ID NO: 3645)
Pro Gly Thr Cys Gly Glu Xaa' Ile Cys Ala Tyr Xaa' Ala Ala Cys Thr Gly Cys       (SEQ ID NO: 3646)
Pro Gly Thr Cys Gly Glu Xaa' Ile Cys Ala Tyr Xaa' Ala Ala Cys Thr Gly Cys       (SEQ ID NO: 3647)
Pro Gly Thr Cys Gly Glu Xaa' Ile Cys Ala Tyr Xaa' Xaa' Ala Ala Cys Thr Gly Cys  (SEQ ID NO: 3648)
Pro Gly Thr Cys Gly Glu Xaa' Ile Cys Ala Tyr Xaa' Xaa' Ala Xaa' Ala Cys Thr Gly Cys  (SEQ ID NO: 3649)
Pro Gly Thr Cys Gly Glu Xaa' Ile Cys Ala Tyr Xaa' Xaa' Ala Ala Xaa' Cys Thr Gly Cys  (SEQ ID NO: 3650)
Pro Gly Thr Cys Gly Glu Xaa' Ile Cys Ala Tyr Xaa' Xaa' Ala Ala Cys Xaa' Thr Gly Cys  (SEQ ID NO: 3651)
Pro Gly Thr Cys Gly Glu Xaa' Ile Cys Ala Tyr Xaa' Xaa' Ala Ala Cys Thr Xaa' Gly Cys  (SEQ ID NO: 3652)
Pro Gly Thr Cys Gly Glu Xaa' Ile Cys Ala Tyr Xaa' Xaa' Ala Ala Cys Thr Gly Xaa' Cys  (SEQ ID NO: 3653)
Pro Gly Thr Cys Gly Glu Xaa' Ile Cys Ala Tyr Xaa' Xaa' Ala Ala Cys Thr Gly Cys Xaa'  (SEQ ID NO: 3654)
Pro Gly Thr Cys Gly Glu Xaa' Ile Cys Ala Tyr Xaa' Ala Xaa' Ala Cys Thr Gly Cys  (SEQ ID NO: 3655)
Pro Gly Thr Cys Gly Glu Xaa' Ile Cys Ala Tyr Xaa' Ala Xaa' Ala Xaa' Cys Thr Gly Cys  (SEQ ID NO: 3656)
Pro Gly Thr Cys Gly Glu Xaa' Ile Cys Ala Tyr Xaa' Ala Xaa' Ala Cys Xaa' Thr Gly Cys  (SEQ ID NO: 3657)
Pro Gly Thr Cys Gly Glu Xaa' Ile Cys Ala Tyr Xaa' Ala Xaa' Ala Cys Thr Xaa' Gly Cys  (SEQ ID NO: 3658)
Pro Gly Thr Cys Gly Glu Xaa' Ile Cys Ala Tyr Xaa' Ala Xaa' Ala Cys Thr Gly Xaa' Cys  (SEQ ID NO: 3659)
Pro Gly Thr Cys Gly Glu Xaa' Ile Cys Ala Tyr Xaa' Ala Xaa' Ala Cys Thr Gly Cys Xaa'  (SEQ ID NO: 3660)
Pro Gly Thr Cys Gly Glu Xaa' Ile Cys Ala Tyr Xaa' Ala Ala Xaa' Cys Thr Gly Cys  (SEQ ID NO: 3661)
Pro Gly Thr Cys Gly Glu Xaa' Ile Cys Ala Tyr Xaa' Ala Ala Xaa' Cys Xaa' Thr Gly Cys  (SEQ ID NO: 3662)
Pro Gly Thr Cys Gly Glu Xaa' Ile Cys Ala Tyr Xaa' Ala Ala Xaa' Cys Thr Xaa' Gly Cys  (SEQ ID NO: 3663)
Pro Gly Thr Cys Gly Glu Xaa' Ile Cys Ala Tyr Xaa' Ala Ala Xaa' Cys Thr Gly Xaa' Cys  (SEQ ID NO: 3664)
Pro Gly Thr Cys Gly Glu Xaa' Ile Cys Ala Tyr Xaa' Ala Ala Xaa' Cys Thr Gly Cys Xaa'  (SEQ ID NO: 3665)
Pro Gly Thr Cys Gly Glu Xaa' Ile Cys Ala Tyr Xaa' Ala Ala Cys Xaa' Thr Gly Cys  (SEQ ID NO: 3666)
Pro Gly Thr Cys Gly Glu Xaa' Ile Cys Ala Tyr Xaa' Ala Ala Cys Xaa' Thr Xaa' Gly Cys  (SEQ ID NO: 3667)
Pro Gly Thr Cys Gly Glu Xaa' Ile Cys Ala Tyr Xaa' Ala Ala Cys Xaa' Thr Gly Xaa' Cys  (SEQ ID NO: 3668)
Pro Gly Thr Cys Gly Glu Xaa' Ile Cys Ala Tyr Xaa' Ala Ala Cys Xaa' Thr Gly Cys Xaa'  (SEQ ID NO: 3669)
Pro Gly Thr Cys Gly Glu Xaa' Ile Cys Ala Tyr Xaa' Ala Ala Cys Thr Xaa' Gly Cys       (SEQ ID NO: 3670)
Pro Gly Thr Cys Gly Glu Xaa' Ile Cys Ala Tyr Xaa' Ala Ala Cys Thr Xaa' Gly Xaa' Cys  (SEQ ID NO: 3671)
Pro Gly Thr Cys Gly Glu Xaa' Ile Cys Ala Tyr Xaa' Ala Ala Cys Thr Xaa' Gly Cys Xaa'  (SEQ ID NO: 3672)
Pro Gly Thr Cys Gly Glu Xaa' Ile Cys Ala Tyr Xaa' Ala Ala Cys Thr Gly Xaa' Cys       (SEQ ID NO: 3673)
Pro Gly Thr Cys Gly Glu Xaa' Ile Cys Ala Tyr Xaa' Ala Ala Cys Thr Gly Xaa' Cys Xaa'  (SEQ ID NO: 3674)
Pro Gly Thr Cys Gly Glu Xaa' Ile Cys Ala Tyr Xaa' Ala Ala Cys Thr Gly Cys Xaa'       (SEQ ID NO: 3675)
Pro Gly Thr Cys Gly Glu Xaa' Ile Cys Ala Tyr Xaa' Ala Ala Cys Thr Gly Cys            (SEQ ID NO: 3676)
```

FIG. 2

| Sequence | SEQ ID |
|---|---|
| Pro Gly Thr Cys Gly Glu Xaa' Ile Cys Ala Tyr Xaa' Ala Ala Cys Thr Gly Xaa' Xaa' Cys | (SEQ ID NO: 3677) |
| Pro Gly Thr Cys Gly Glu Xaa' Ile Cys Ala Tyr Xaa' Ala Ala Cys Thr Gly Xaa' Cys Xaa' | (SEQ ID NO: 3678) |
| Pro Gly Thr Cys Gly Glu Xaa' Ile Cys Ala Tyr Xaa' Ala Ala Cys Thr Gly Cys Xaa' | (SEQ ID NO: 3679) |
| Pro Gly Thr Cys Gly Glu Xaa' Ile Cys Ala Tyr Xaa' Ala Ala Cys Thr Gly Cys Xaa' Xaa' | (SEQ ID NO: 3680) |
| Pro Gly Thr Cys Gly Glu Xaa' Ile Cys Ala Tyr Ala Ala Xaa' Ala Cys Thr Gly Cys | (SEQ ID NO: 3681) |
| Pro Gly Thr Cys Gly Glu Xaa' Ile Cys Ala Tyr Xaa' Ala Xaa' Ala Cys Thr Gly Cys | (SEQ ID NO: 3682) |
| Pro Gly Thr Cys Gly Glu Xaa' Ile Cys Ala Tyr Xaa' Ala Xaa' Xaa' Ala Cys Thr Gly Cys | (SEQ ID NO: 3683) |
| Pro Gly Thr Cys Gly Glu Xaa' Ile Cys Ala Tyr Xaa' Ala Xaa' Ala Cys Thr Gly Cys Xaa' | (SEQ ID NO: 3684) |
| Pro Gly Thr Cys Gly Glu Xaa' Ile Cys Ala Tyr Xaa' Ala Xaa' Xaa' Ala Cys Thr Gly Gly Cys | (SEQ ID NO: 3685) |
| Pro Gly Thr Cys Gly Glu Xaa' Ile Cys Ala Tyr Xaa' Ala Xaa' Ala Cys Xaa' Thr Gly Cys | (SEQ ID NO: 3686) |
| Pro Gly Thr Cys Gly Glu Xaa' Ile Cys Ala Tyr Xaa' Ala Xaa' Ala Cys Thr Gly Xaa' Cys | (SEQ ID NO: 3687) |
| Pro Gly Thr Cys Gly Glu Xaa' Ile Cys Ala Tyr Xaa' Ala Xaa' Ala Cys Thr Gly Cys Xaa' | (SEQ ID NO: 3688) |
| Pro Gly Thr Cys Gly Glu Xaa' Ile Cys Ala Tyr Xaa' Ala Xaa' Xaa' Ala Xaa' Cys Thr Gly Cys | (SEQ ID NO: 3689) |
| Pro Gly Thr Cys Gly Glu Xaa' Ile Cys Ala Tyr Xaa' Ala Xaa' Xaa' Ala Cys Xaa' Thr Gly Cys | (SEQ ID NO: 3690) |
| Pro Gly Thr Cys Gly Glu Xaa' Ile Cys Ala Tyr Xaa' Ala Xaa' Xaa' Ala Cys Xaa' Thr Gly Cys | (SEQ ID NO: 3691) |
| Pro Gly Thr Cys Gly Glu Xaa' Ile Cys Ala Tyr Xaa' Ala Xaa' Xaa' Ala Cys Thr Xaa' Gly Cys | (SEQ ID NO: 3692) |
| Pro Gly Thr Cys Gly Glu Xaa' Ile Cys Ala Tyr Xaa' Ala Xaa' Xaa' Ala Cys Thr Gly Xaa' Cys | (SEQ ID NO: 3693) |
| Pro Gly Thr Cys Gly Glu Xaa' Ile Cys Ala Tyr Xaa' Ala Xaa' Xaa' Ala Cys Thr Gly Cys Xaa' | (SEQ ID NO: 3694) |
| Pro Gly Thr Cys Gly Glu Xaa' Ile Cys Ala Tyr Xaa' Ala Xaa' Xaa' Ala Cys Thr Thr Gly Cys | (SEQ ID NO: 3695) |
| Pro Gly Thr Cys Gly Glu Xaa' Ile Cys Ala Tyr Xaa' Ala Xaa' Xaa' Ala Cys Xaa' Thr Gly Cys | (SEQ ID NO: 3696) |
| Pro Gly Thr Cys Gly Glu Xaa' Ile Cys Ala Tyr Xaa' Ala Xaa' Xaa' Ala Cys Thr Xaa' Gly Cys | (SEQ ID NO: 3697) |
| Pro Gly Thr Cys Gly Glu Xaa' Ile Cys Ala Tyr Xaa' Ala Xaa' Xaa' Ala Cys Thr Gly Xaa' Cys | (SEQ ID NO: 3698) |
| Pro Gly Thr Cys Gly Glu Xaa' Ile Cys Ala Tyr Xaa' Ala Xaa' Xaa' Ala Cys Thr Gly Cys Xaa' | (SEQ ID NO: 3699) |
| Pro Gly Thr Cys Gly Glu Xaa' Ile Cys Ala Tyr Ala Ala Xaa' Ala Cys Thr Xaa' Gly Cys | (SEQ ID NO: 3700) |
| Pro Gly Thr Cys Gly Glu Xaa' Ile Cys Ala Tyr Ala Ala Xaa' Ala Cys Thr Gly Xaa' Cys | (SEQ ID NO: 3701) |
| Pro Gly Thr Cys Gly Glu Xaa' Ile Cys Ala Tyr Ala Ala Xaa' Ala Cys Thr Gly Xaa' Xaa' Cys | (SEQ ID NO: 3702) |
| Pro Gly Thr Cys Gly Glu Xaa' Ile Cys Ala Tyr Ala Ala Xaa' Ala Cys Thr Gly Xaa' Cys Xaa' | (SEQ ID NO: 3703) |
| Pro Gly Thr Cys Gly Glu Xaa' Ile Cys Ala Tyr Ala Ala Xaa' Ala Cys Thr Gly Cys Xaa' | (SEQ ID NO: 3704) |
| Pro Gly Thr Cys Gly Glu Xaa' Ile Cys Ala Tyr Ala Ala Xaa' Ala Cys Thr Gly Cys Xaa' Xaa' | (SEQ ID NO: 3705) |
| Pro Gly Thr Cys Gly Glu Xaa' Ile Cys Ala Tyr Ala Ala Xaa' Ala Cys Thr Gly Cys Xaa' | (SEQ ID NO: 3706) |
| Pro Gly Thr Cys Gly Glu Xaa' Ile Cys Ala Tyr Ala Ala Xaa' Ala Cys Thr Gly Xaa' Cys Xaa' | (SEQ ID NO: 3707) |
| Pro Gly Thr Cys Gly Glu Xaa' Ile Cys Ala Tyr Ala Ala Xaa' Ala Cys Thr Gly Cys Xaa' | (SEQ ID NO: 3708) |
| Pro Gly Thr Cys Gly Glu Xaa' Ile Cys Ala Tyr Ala Ala Ala Ala Xaa' Cys Thr Gly Cys | (SEQ ID NO: 3709) |
| Pro Gly Thr Cys Gly Glu Xaa' Ile Cys Ala Tyr Ala Ala Ala Xaa' Xaa' Cys Thr Gly Cys | (SEQ ID NO: 3710) |

FIG. 2

Pro Gly Thr Cys Gly Glu Xaa' Ile Cys Ala Tyr Ala Ala Xaa' Xaa' Xaa' Cys Thr Gly Cys (SEQID NO: 3711 )
Pro Gly Thr Cys Gly Glu Xaa' Ile Cys Ala Tyr Ala Ala Xaa' Xaa' Cys Xaa' Thr Gly Cys (SEQID NO: 3712 )
Pro Gly Thr Cys Gly Glu Xaa' Ile Cys Ala Tyr Ala Ala Xaa' Xaa' Cys Thr Xaa' Gly Cys (SEQID NO: 3713 )
Pro Gly Thr Cys Gly Glu Xaa' Ile Cys Ala Tyr Ala Ala Xaa' Xaa' Cys Thr Gly Xaa' Cys (SEQID NO: 3714 )
Pro Gly Thr Cys Gly Glu Xaa' Ile Cys Ala Tyr Ala Ala Xaa' Xaa' Cys Thr Gly Cys Xaa' (SEQID NO: 3715 )
Pro Gly Thr Cys Gly Glu Xaa' Ile Cys Ala Tyr Ala Ala Xaa' Cys Xaa' Thr Gly Cys (SEQID NO: 3716 )
Pro Gly Thr Cys Gly Glu Xaa' Ile Cys Ala Tyr Ala Ala Xaa' Cys Xaa' Xaa' Thr Gly Cys (SEQID NO: 3717 )
Pro Gly Thr Cys Gly Glu Xaa' Ile Cys Ala Tyr Ala Ala Xaa' Cys Xaa' Thr Xaa' Gly Cys (SEQID NO: 3718 )
Pro Gly Thr Cys Gly Glu Xaa' Ile Cys Ala Tyr Ala Ala Xaa' Cys Xaa' Thr Gly Xaa' Cys (SEQID NO: 3719 )
Pro Gly Thr Cys Gly Glu Xaa' Ile Cys Ala Tyr Ala Ala Xaa' Cys Xaa' Thr Gly Cys Xaa' (SEQID NO: 3720 )
Pro Gly Thr Cys Gly Glu Xaa' Ile Cys Ala Tyr Ala Ala Xaa' Cys Thr Xaa' Gly Cys (SEQID NO: 3721 )
Pro Gly Thr Cys Gly Glu Xaa' Ile Cys Ala Tyr Ala Ala Xaa' Cys Thr Xaa' Xaa' Gly Cys (SEQID NO: 3722 )
Pro Gly Thr Cys Gly Glu Xaa' Ile Cys Ala Tyr Ala Ala Xaa' Cys Thr Xaa' Gly Xaa' Cys (SEQID NO: 3723 )
Pro Gly Thr Cys Gly Glu Xaa' Ile Cys Ala Tyr Ala Ala Xaa' Cys Thr Xaa' Gly Cys Xaa' (SEQID NO: 3724 )
Pro Gly Thr Cys Gly Glu Xaa' Ile Cys Ala Tyr Ala Ala Xaa' Cys Thr Gly Xaa' Cys (SEQID NO: 3725 )
Pro Gly Thr Cys Gly Glu Xaa' Ile Cys Ala Tyr Ala Ala Xaa' Cys Thr Gly Xaa' Xaa' Cys (SEQID NO: 3726 )
Pro Gly Thr Cys Gly Glu Xaa' Ile Cys Ala Tyr Ala Ala Xaa' Cys Thr Gly Xaa' Cys Xaa' (SEQID NO: 3727 )
Pro Gly Thr Cys Gly Glu Xaa' Ile Cys Ala Tyr Ala Ala Xaa' Cys Thr Gly Cys Xaa' (SEQID NO: 3728 )
Pro Gly Thr Cys Gly Glu Xaa' Ile Cys Ala Tyr Ala Ala Xaa' Cys Thr Gly Cys Xaa' Xaa' (SEQID NO: 3729 )
Pro Gly Thr Cys Gly Glu Xaa' Ile Cys Ala Tyr Ala Ala Cys Xaa' Thr Gly Cys (SEQID NO: 3730 )
Pro Gly Thr Cys Gly Glu Xaa' Ile Cys Ala Tyr Ala Ala Cys Xaa' Xaa' Thr Gly Cys (SEQID NO: 3731 )
Pro Gly Thr Cys Gly Glu Xaa' Ile Cys Ala Tyr Ala Ala Cys Xaa' Xaa' Xaa' Thr Gly Cys (SEQID NO: 3732 )
Pro Gly Thr Cys Gly Glu Xaa' Ile Cys Ala Tyr Ala Ala Cys Xaa' Xaa' Thr Xaa' Gly Cys (SEQID NO: 3733 )
Pro Gly Thr Cys Gly Glu Xaa' Ile Cys Ala Tyr Ala Ala Cys Xaa' Xaa' Thr Gly Xaa' Cys (SEQID NO: 3734 )
Pro Gly Thr Cys Gly Glu Xaa' Ile Cys Ala Tyr Ala Ala Cys Xaa' Xaa' Thr Gly Cys Xaa' (SEQID NO: 3735 )
Pro Gly Thr Cys Gly Glu Xaa' Ile Cys Ala Tyr Ala Ala Cys Xaa' Thr Xaa' Gly Cys (SEQID NO: 3736 )
Pro Gly Thr Cys Gly Glu Xaa' Ile Cys Ala Tyr Ala Ala Cys Xaa' Thr Xaa' Xaa' Gly Cys (SEQID NO: 3737 )
Pro Gly Thr Cys Gly Glu Xaa' Ile Cys Ala Tyr Ala Ala Cys Xaa' Thr Xaa' Gly Xaa' Cys (SEQID NO: 3738 )
Pro Gly Thr Cys Gly Glu Xaa' Ile Cys Ala Tyr Ala Ala Cys Xaa' Thr Xaa' Gly Cys Xaa' (SEQID NO: 3739 )
Pro Gly Thr Cys Gly Glu Xaa' Ile Cys Ala Tyr Ala Ala Cys Xaa' Thr Gly Xaa' Cys (SEQID NO: 3740 )
Pro Gly Thr Cys Gly Glu Xaa' Ile Cys Ala Tyr Ala Ala Cys Xaa' Thr Gly Xaa' Xaa' Cys (SEQID NO: 3741 )
Pro Gly Thr Cys Gly Glu Xaa' Ile Cys Ala Tyr Ala Ala Cys Xaa' Thr Gly Xaa' Cys Xaa' (SEQID NO: 3742 )
Pro Gly Thr Cys Gly Glu Xaa' Ile Cys Ala Tyr Ala Ala Cys Xaa' Thr Gly Cys Xaa' (SEQID NO: 3743 )
Pro Gly Thr Cys Gly Glu Xaa' Ile Cys Ala Tyr Ala Ala Cys Xaa' Thr Gly Cys Xaa' Xaa' (SEQID NO: 3744 )

FIG. 2

| Sequence | SEQ ID NO |
|---|---|
| Pro Gly Thr Cys Gly Glu Xaa' Ile Cys Ala Tyr Ala Ala Cys Thr Xaa' Gly Cys | (SEQ ID NO: 3745) |
| Pro Gly Thr Cys Gly Glu Xaa' Ile Cys Ala Tyr Ala Ala Cys Thr Xaa' Ala Cys | (SEQ ID NO: 3746) |
| Pro Gly Thr Cys Gly Glu Xaa' Ile Cys Ala Tyr Ala Ala Cys Thr Xaa' Xaa' Gly Cys | (SEQ ID NO: 3747) |
| Pro Gly Thr Cys Gly Glu Xaa' Ile Cys Ala Tyr Ala Ala Cys Thr Xaa' Xaa' Ala Cys | (SEQ ID NO: 3748) |
| Pro Gly Thr Cys Gly Glu Xaa' Ile Cys Ala Tyr Ala Ala Cys Thr Xaa' Xaa' Xaa' Gly Cys | (SEQ ID NO: 3749) |
| Pro Gly Thr Cys Gly Glu Xaa' Ile Cys Ala Tyr Ala Ala Cys Thr Xaa' Xaa' Xaa' Cys | (SEQ ID NO: 3750) |
| Pro Gly Thr Cys Gly Glu Xaa' Ile Cys Ala Tyr Ala Ala Cys Thr Xaa' Xaa' Xaa' Gly Xaa' | (SEQ ID NO: 3751) |
| Pro Gly Thr Cys Gly Glu Xaa' Ile Cys Ala Tyr Ala Ala Cys Thr Xaa' Xaa' Xaa' Xaa' Cys | (SEQ ID NO: 3752) |
| Pro Gly Thr Cys Gly Glu Xaa' Ile Cys Ala Tyr Ala Ala Cys Thr Xaa' Xaa' Gly Xaa' | (SEQ ID NO: 3753) |
| Pro Gly Thr Cys Gly Glu Xaa' Ile Cys Ala Tyr Ala Ala Cys Thr Xaa' Gly Cys Xaa' | (SEQ ID NO: 3754) |
| Pro Gly Thr Cys Gly Glu Xaa' Ile Cys Ala Tyr Ala Ala Cys Thr Xaa' Gly Xaa' Xaa' | (SEQ ID NO: 3755) |
| Pro Gly Thr Cys Gly Glu Xaa' Ile Cys Ala Tyr Ala Ala Cys Thr Gly Xaa' Cys | (SEQ ID NO: 3756) |
| Pro Gly Thr Cys Gly Glu Xaa' Ile Cys Ala Tyr Ala Ala Cys Thr Gly Xaa' Xaa' Cys | (SEQ ID NO: 3757) |
| Pro Gly Thr Cys Gly Glu Xaa' Ile Cys Ala Tyr Ala Ala Cys Thr Gly Xaa' Xaa' Xaa' Cys | (SEQ ID NO: 3758) |
| Pro Gly Thr Cys Gly Glu Xaa' Ile Cys Ala Tyr Ala Ala Cys Thr Gly Xaa' Cys Xaa' | (SEQ ID NO: 3759) |
| Pro Gly Thr Cys Gly Glu Xaa' Ile Cys Ala Tyr Ala Ala Cys Thr Gly Xaa' Cys Xaa' | (SEQ ID NO: 3760) |
| Pro Gly Thr Cys Gly Glu Xaa' Ile Cys Ala Tyr Ala Ala Cys Thr Gly Cys Xaa' | (SEQ ID NO: 3761) |
| Pro Gly Thr Cys Gly Glu Ile Xaa' Cys Ala Tyr Ala Ala Cys Thr Gly Cys Xaa' Xaa' | (SEQ ID NO: 3762) |
| Pro Gly Thr Cys Gly Glu Ile Xaa' Cys Ala Tyr Ala Ala Cys Thr Gly Cys Xaa' Xaa' Xaa' | (SEQ ID NO: 3763) |
| Pro Gly Thr Cys Gly Glu Ile Xaa' Cys Ala Tyr Ala Ala Cys Thr Gly Cys | (SEQ ID NO: 3764) |
| Pro Gly Thr Cys Gly Glu Ile Xaa' Cys Ala Tyr Ala Ala Cys Thr Gly Cys | (SEQ ID NO: 3765) |
| Pro Gly Thr Cys Gly Glu Ile Xaa' Cys Ala Xaa' Xaa' Xaa' Cys Ala Tyr Ala Ala Cys Thr Gly Cys | (SEQ ID NO: 3766) |
| Pro Gly Thr Cys Gly Glu Ile Xaa' Cys Ala Xaa' Xaa' Cys Ala Tyr Ala Ala Cys Thr Gly Cys | (SEQ ID NO: 3767) |
| Pro Gly Thr Cys Gly Glu Ile Xaa' Cys Ala Xaa' Cys Ala Tyr Ala Ala Cys Thr Gly Cys | (SEQ ID NO: 3768) |
| Pro Gly Thr Cys Gly Glu Ile Xaa' Cys Ala Xaa' Cys Xaa' Ala Tyr Ala Ala Cys Thr Gly Cys | (SEQ ID NO: 3769) |
| Pro Gly Thr Cys Gly Glu Ile Xaa' Cys Ala Xaa' Cys Ala Tyr Xaa' Ala Ala Cys Thr Gly Cys | (SEQ ID NO: 3770) |
| Pro Gly Thr Cys Gly Glu Ile Xaa' Cys Ala Xaa' Cys Ala Tyr Ala Xaa' Ala Cys Thr Gly Cys | (SEQ ID NO: 3771) |
| Pro Gly Thr Cys Gly Glu Ile Xaa' Cys Ala Xaa' Cys Ala Tyr Ala Ala Xaa' Cys Thr Gly Cys | (SEQ ID NO: 3772) |
| Pro Gly Thr Cys Gly Glu Ile Xaa' Cys Ala Xaa' Cys Ala Tyr Ala Ala Cys Xaa' Thr Gly Cys | (SEQ ID NO: 3773) |
| Pro Gly Thr Cys Gly Glu Ile Xaa' Cys Ala Xaa' Cys Ala Tyr Ala Ala Cys Thr Xaa' Gly Cys | (SEQ ID NO: 3774) |
| Pro Gly Thr Cys Gly Glu Ile Xaa' Cys Ala Xaa' Cys Ala Tyr Ala Ala Cys Thr Ala Cys Xaa' | (SEQ ID NO: 3775) |
| Pro Gly Thr Cys Gly Glu Ile Xaa' Cys Cys Xaa' Xaa' Ala Tyr Ala Ala Cys Thr Gly Cys | (SEQ ID NO: 3776) |
| Pro Gly Thr Cys Gly Glu Ile Xaa' Cys Xaa' Xaa' Ala Tyr Ala Ala Cys Thr Gly Cys | (SEQ ID NO: 3777) |
| Pro Gly Thr Cys Gly Glu Ile Xaa' Cys Xaa' Xaa' Ala Tyr Ala Ala Cys Thr Gly Cys | (SEQ ID NO: 3778) |

FIG. 2

| | | | | | | | | | | | | |
|---|---|---|---|---|---|---|---|---|---|---|---|---|
| Pro Gly Thr Cys Gly Glu Ile Xaa' Xaa' Cys Xaa' Ala Xaa' Tyr Ala Ala Cys Thr Gly Cys | (SEQID NO: 3779) |
| Pro Gly Thr Cys Gly Glu Ile Xaa' Xaa' Cys Xaa' Ala Tyr Xaa' Ala Ala Cys Thr Gly Cys | (SEQID NO: 3780) |
| Pro Gly Thr Cys Gly Glu Ile Xaa' Xaa' Cys Xaa' Ala Tyr Ala Xaa' Ala Cys Thr Gly Cys | (SEQID NO: 3781) |
| Pro Gly Thr Cys Gly Glu Ile Xaa' Xaa' Cys Xaa' Ala Tyr Ala Ala Xaa' Cys Thr Gly Cys | (SEQID NO: 3782) |
| Pro Gly Thr Cys Gly Glu Ile Xaa' Xaa' Cys Xaa' Ala Tyr Ala Ala Cys Xaa' Thr Gly Cys | (SEQID NO: 3783) |
| Pro Gly Thr Cys Gly Glu Ile Xaa' Xaa' Cys Xaa' Ala Tyr Ala Ala Cys Thr Xaa' Gly Cys | (SEQID NO: 3784) |
| Pro Gly Thr Cys Gly Glu Ile Xaa' Xaa' Cys Xaa' Ala Tyr Ala Ala Cys Thr Gly Xaa' Cys | (SEQID NO: 3785) |
| Pro Gly Thr Cys Gly Glu Ile Xaa' Xaa' Cys Xaa' Ala Tyr Ala Ala Cys Thr Gly Cys Xaa' | (SEQID NO: 3786) |
| Pro Gly Thr Cys Gly Glu Ile Xaa' Xaa' Cys Ala Xaa' Xaa' Ala Ala Cys Thr Gly Cys | (SEQID NO: 3787) |
| Pro Gly Thr Cys Gly Glu Ile Xaa' Xaa' Cys Ala Xaa' Tyr Ala Ala Cys Thr Gly Cys | (SEQID NO: 3788) |
| Pro Gly Thr Cys Gly Glu Ile Xaa' Xaa' Cys Ala Xaa' Tyr Xaa' Ala Ala Cys Thr Gly Cys | (SEQID NO: 3789) |
| Pro Gly Thr Cys Gly Glu Ile Xaa' Xaa' Cys Ala Xaa' Tyr Ala Xaa' Ala Cys Thr Gly Cys | (SEQID NO: 3790) |
| Pro Gly Thr Cys Gly Glu Ile Xaa' Xaa' Cys Ala Xaa' Tyr Ala Ala Xaa' Cys Thr Gly Cys | (SEQID NO: 3791) |
| Pro Gly Thr Cys Gly Glu Ile Xaa' Xaa' Cys Ala Xaa' Tyr Ala Ala Cys Xaa' Thr Gly Cys | (SEQID NO: 3792) |
| Pro Gly Thr Cys Gly Glu Ile Xaa' Xaa' Cys Ala Xaa' Tyr Ala Ala Cys Thr Xaa' Gly Cys | (SEQID NO: 3793) |
| Pro Gly Thr Cys Gly Glu Ile Xaa' Xaa' Cys Ala Xaa' Tyr Ala Ala Cys Thr Gly Xaa' Cys | (SEQID NO: 3794) |
| Pro Gly Thr Cys Gly Glu Ile Xaa' Xaa' Cys Ala Xaa' Tyr Ala Ala Cys Thr Gly Cys Xaa' | (SEQID NO: 3795) |
| Pro Gly Thr Cys Gly Glu Ile Xaa' Xaa' Cys Ala Tyr Xaa' Ala Ala Cys Thr Gly Cys | (SEQID NO: 3796) |
| Pro Gly Thr Cys Gly Glu Ile Xaa' Xaa' Cys Ala Tyr Xaa' Xaa' Ala Ala Cys Thr Gly Cys | (SEQID NO: 3797) |
| Pro Gly Thr Cys Gly Glu Ile Xaa' Xaa' Cys Ala Tyr Xaa' Ala Xaa' Ala Cys Thr Gly Cys | (SEQID NO: 3798) |
| Pro Gly Thr Cys Gly Glu Ile Xaa' Xaa' Cys Ala Tyr Xaa' Ala Ala Xaa' Cys Thr Gly Cys | (SEQID NO: 3799) |
| Pro Gly Thr Cys Gly Glu Ile Xaa' Xaa' Cys Ala Tyr Xaa' Ala Ala Cys Xaa' Thr Gly Cys | (SEQID NO: 3800) |
| Pro Gly Thr Cys Gly Glu Ile Xaa' Xaa' Cys Ala Tyr Xaa' Ala Ala Cys Thr Xaa' Gly Cys | (SEQID NO: 3801) |
| Pro Gly Thr Cys Gly Glu Ile Xaa' Xaa' Cys Ala Tyr Xaa' Ala Ala Cys Thr Gly Xaa' Cys | (SEQID NO: 3802) |
| Pro Gly Thr Cys Gly Glu Ile Xaa' Xaa' Cys Ala Tyr Xaa' Ala Ala Cys Thr Gly Cys Xaa' | (SEQID NO: 3803) |
| Pro Gly Thr Cys Gly Glu Ile Xaa' Xaa' Cys Ala Tyr Ala Xaa' Ala Cys Thr Gly Cys | (SEQID NO: 3804) |
| Pro Gly Thr Cys Gly Glu Ile Xaa' Xaa' Cys Ala Tyr Ala Xaa' Xaa' Ala Cys Thr Gly Cys | (SEQID NO: 3805) |
| Pro Gly Thr Cys Gly Glu Ile Xaa' Xaa' Cys Ala Tyr Ala Xaa' Ala Xaa' Cys Thr Gly Cys | (SEQID NO: 3806) |
| Pro Gly Thr Cys Gly Glu Ile Xaa' Xaa' Cys Ala Tyr Ala Xaa' Ala Cys Xaa' Thr Gly Cys | (SEQID NO: 3807) |
| Pro Gly Thr Cys Gly Glu Ile Xaa' Xaa' Cys Ala Tyr Ala Xaa' Ala Cys Thr Xaa' Gly Cys | (SEQID NO: 3808) |
| Pro Gly Thr Cys Gly Glu Ile Xaa' Xaa' Cys Ala Tyr Ala Xaa' Ala Cys Thr Gly Xaa' Cys | (SEQID NO: 3809) |
| Pro Gly Thr Cys Gly Glu Ile Xaa' Xaa' Cys Ala Tyr Ala Xaa' Ala Cys Thr Gly Cys Xaa' | (SEQID NO: 3810) |
| Pro Gly Thr Cys Gly Glu Ile Xaa' Xaa' Cys Ala Tyr Ala Ala Xaa' Cys Thr Gly Cys | (SEQID NO: 3811) |
| Pro Gly Thr Cys Gly Glu Ile Xaa' Xaa' Cys Ala Tyr Ala Ala Xaa' Xaa' Cys Thr Gly Cys | (SEQID NO: 3812) |

FIG. 2

| | | | | | | | | | | | | |
|---|---|---|---|---|---|---|---|---|---|---|---|---|
| Pro Gly Thr Cys Gly Glu Ile Xaa' | Xaa' | Cys Ala Tyr Ala Ala Xaa' | Cys Xaa' | Thr Gly Cys | (SEQ ID NO: 3813) |
| Pro Gly Thr Cys Gly Glu Ile Xaa' | Xaa' | Cys Ala Tyr Ala Ala Xaa' | Cys Thr Xaa' | Gly Cys | (SEQ ID NO: 3814) |
| Pro Gly Thr Cys Gly Glu Ile Xaa' | Xaa' | Cys Ala Tyr Ala Ala Xaa' | Cys Thr Gly Xaa' | Cys | (SEQ ID NO: 3815) |
| Pro Gly Thr Cys Gly Glu Ile Xaa' | Xaa' | Cys Ala Tyr Ala Ala Xaa' | Cys Thr Gly Cys Xaa' | (SEQ ID NO: 3816) |
| Pro Gly Thr Cys Gly Glu Ile Xaa' | Xaa' | Cys Ala Tyr Ala Ala Ala | Cys Xaa' Thr Gly Cys | (SEQ ID NO: 3817) |
| Pro Gly Thr Cys Gly Glu Ile Xaa' | Xaa' | Cys Ala Tyr Ala Ala Ala | Cys Thr Xaa' Gly Cys | (SEQ ID NO: 3818) |
| Pro Gly Thr Cys Gly Glu Ile Xaa' | Xaa' | Cys Ala Tyr Ala Ala Ala | Cys Thr Gly Xaa' Cys | (SEQ ID NO: 3819) |
| Pro Gly Thr Cys Gly Glu Ile Xaa' | Xaa' | Cys Ala Tyr Ala Ala Ala | Cys Thr Gly Cys Xaa' | (SEQ ID NO: 3820) |
| Pro Gly Thr Cys Gly Glu Ile Xaa' | Xaa' | Cys Ala Tyr Ala Ala Cys | Thr Xaa' Gly Cys | (SEQ ID NO: 3821) |
| Pro Gly Thr Cys Gly Glu Ile Xaa' | Xaa' | Cys Ala Tyr Ala Ala Cys | Thr Gly Xaa' Cys | (SEQ ID NO: 3822) |
| Pro Gly Thr Cys Gly Glu Ile Xaa' | Xaa' | Cys Ala Tyr Ala Ala Cys | Thr Gly Cys Xaa' | (SEQ ID NO: 3823) |
| Pro Gly Thr Cys Gly Glu Ile Xaa' | Xaa' | Cys Ala Tyr Ala Xaa' | Ala Cys Thr Gly Cys | (SEQ ID NO: 3824) |
| Pro Gly Thr Cys Gly Glu Ile Xaa' | Xaa' | Cys Ala Tyr Ala Xaa' | Ala Cys Thr Gly Xaa' Cys | (SEQ ID NO: 3825) |
| Pro Gly Thr Cys Gly Glu Ile Xaa' | Xaa' | Cys Ala Tyr Ala Xaa' | Ala Cys Thr Gly Cys Xaa' | (SEQ ID NO: 3826) |
| Pro Gly Thr Cys Gly Glu Ile Xaa' | Xaa' | Cys Ala Tyr Ala Xaa' | Ala Cys Xaa' Thr Gly Cys | (SEQ ID NO: 3827) |
| Pro Gly Thr Cys Gly Glu Ile Xaa' | Xaa' | Cys Ala Tyr Ala Xaa' | Ala Cys Thr Xaa' Gly Cys | (SEQ ID NO: 3828) |
| Pro Gly Thr Cys Gly Glu Ile Xaa' | Xaa' | Cys Ala Tyr Xaa' | Ala Ala Cys Thr Gly Cys | (SEQ ID NO: 3829) |
| Pro Gly Thr Cys Gly Glu Ile Xaa' | Xaa' | Cys Ala Tyr Xaa' | Ala Ala Cys Thr Gly Cys Xaa' | (SEQ ID NO: 3830) |
| Pro Gly Thr Cys Gly Glu Ile Xaa' | Xaa' | Cys Xaa' Ala Tyr Ala Ala Ala Cys Thr Gly Cys | (SEQ ID NO: 3831) |
| Pro Gly Thr Cys Gly Glu Ile Xaa' | Cys Xaa' | Ala Tyr Ala Ala Ala Cys Thr Gly Cys | (SEQ ID NO: 3832) |
| Pro Gly Thr Cys Gly Glu Ile Xaa' | Cys Xaa' | Ala Tyr Ala Ala Xaa' Ala Cys Thr Gly Cys | (SEQ ID NO: 3833) |
| Pro Gly Thr Cys Gly Glu Ile Xaa' | Cys Xaa' | Ala Xaa' Tyr Ala Ala Ala Cys Thr Gly Cys | (SEQ ID NO: 3834) |
| Pro Gly Thr Cys Gly Glu Ile Xaa' | Cys Xaa' | Ala Tyr Xaa' Ala Ala Ala Cys Thr Gly Cys | (SEQ ID NO: 3835) |
| Pro Gly Thr Cys Gly Glu Ile Xaa' | Cys Xaa' | Ala Tyr Ala Xaa' Ala Ala Cys Thr Gly Cys | (SEQ ID NO: 3836) |
| Pro Gly Thr Cys Gly Glu Ile Xaa' | Cys Xaa' | Ala Tyr Ala Ala Xaa' Cys Thr Gly Cys | (SEQ ID NO: 3837) |
| Pro Gly Thr Cys Gly Glu Ile Xaa' | Cys Xaa' | Ala Tyr Ala Ala' Ala Cys Thr Gly Cys | (SEQ ID NO: 3838) |
| Pro Gly Thr Cys Gly Glu Ile Xaa' | Cys Xaa' | Ala Tyr Ala Ala Ala Cys Xaa' Thr Gly Cys | (SEQ ID NO: 3839) |
| Pro Gly Thr Cys Gly Glu Ile Xaa' | Cys Xaa' | Ala Tyr Ala Ala Ala Cys Thr Xaa' Gly Cys | (SEQ ID NO: 3840) |
| Pro Gly Thr Cys Gly Glu Ile Xaa' | Cys Xaa' | Ala Tyr Ala Ala Ala Cys Thr Gly Xaa' Cys | (SEQ ID NO: 3841) |
| Pro Gly Thr Cys Gly Glu Ile Xaa' | Cys Xaa' | Ala Tyr Ala Ala Ala Cys Thr Gly Cys Xaa' | (SEQ ID NO: 3842) |
| Pro Gly Thr Cys Gly Glu Ile Xaa' | Cys Xaa' | Ala Xaa' Tyr Ala Ala Ala Cys Thr Gly Cys | (SEQ ID NO: 3843) |
| Pro Gly Thr Cys Gly Glu Ile Xaa' | Cys Xaa' | Ala Xaa' Tyr Ala Ala Ala Cys Thr Gly Cys | (SEQ ID NO: 3844) |
| Pro Gly Thr Cys Gly Glu Ile Xaa' | Cys Xaa' | Ala Xaa' Tyr Ala Ala Xaa' Ala Cys Thr Gly Cys | (SEQ ID NO: 3845) |
| Pro Gly Thr Cys Gly Glu Ile Xaa' | Cys Xaa' | Ala Xaa' Tyr Ala Ala Xaa' Ala Cys Thr Gly Cys | (SEQ ID NO: 3846) |

FIG. 2

| | | | | | | | | | | | | |
|---|---|---|---|---|---|---|---|---|---|---|---|---|
| Pro Gly Thr Cys Gly Glu Ile Xaa' Cys Xaa' Ala Xaa' Tyr Ala Ala Cys Xaa' Thr Gly Cys | (SEQ ID NO: 3847) |
| Pro Gly Thr Cys Gly Glu Ile Xaa' Cys Xaa' Ala Xaa' Tyr Ala Ala Cys Thr Xaa' Gly Cys | (SEQ ID NO: 3848) |
| Pro Gly Thr Cys Gly Glu Ile Xaa' Cys Xaa' Ala Xaa' Tyr Ala Ala Cys Thr Gly Xaa' Cys | (SEQ ID NO: 3849) |
| Pro Gly Thr Cys Gly Glu Ile Xaa' Cys Xaa' Ala Xaa' Tyr Ala Ala Cys Thr Gly Cys Xaa' | (SEQ ID NO: 3850) |
| Pro Gly Thr Cys Gly Glu Ile Xaa' Cys Xaa' Ala Tyr Xaa' Ala Ala Cys Thr Gly Cys | (SEQ ID NO: 3851) |
| Pro Gly Thr Cys Gly Glu Ile Xaa' Cys Xaa' Ala Tyr Xaa' Ala Ala Cys Xaa' Thr Gly Cys | (SEQ ID NO: 3852) |
| Pro Gly Thr Cys Gly Glu Ile Xaa' Cys Xaa' Ala Tyr Xaa' Ala Ala Cys Thr Xaa' Gly Cys | (SEQ ID NO: 3853) |
| Pro Gly Thr Cys Gly Glu Ile Xaa' Cys Xaa' Ala Tyr Xaa' Ala Ala Cys Thr Gly Xaa' Cys | (SEQ ID NO: 3854) |
| Pro Gly Thr Cys Gly Glu Ile Xaa' Cys Xaa' Ala Tyr Xaa' Ala Ala Cys Thr Gly Cys Xaa' | (SEQ ID NO: 3855) |
| Pro Gly Thr Cys Gly Glu Ile Xaa' Cys Xaa' Ala Tyr Ala Xaa' Ala Cys Thr Gly Cys | (SEQ ID NO: 3856) |
| Pro Gly Thr Cys Gly Glu Ile Xaa' Cys Xaa' Ala Tyr Ala Xaa' Ala Cys Xaa' Thr Gly Cys | (SEQ ID NO: 3857) |
| Pro Gly Thr Cys Gly Glu Ile Xaa' Cys Xaa' Ala Tyr Ala Xaa' Ala Cys Thr Xaa' Gly Cys | (SEQ ID NO: 3858) |
| Pro Gly Thr Cys Gly Glu Ile Xaa' Cys Xaa' Ala Tyr Ala Xaa' Ala Cys Thr Gly Xaa' Cys | (SEQ ID NO: 3859) |
| Pro Gly Thr Cys Gly Glu Ile Xaa' Cys Xaa' Ala Tyr Ala Xaa' Ala Cys Thr Gly Cys Xaa' | (SEQ ID NO: 3860) |
| Pro Gly Thr Cys Gly Glu Ile Xaa' Cys Xaa' Ala Tyr Ala Ala Xaa' Cys Thr Gly Cys | (SEQ ID NO: 3861) |
| Pro Gly Thr Cys Gly Glu Ile Xaa' Cys Xaa' Ala Tyr Ala Ala Xaa' Cys Xaa' Thr Gly Cys | (SEQ ID NO: 3862) |
| Pro Gly Thr Cys Gly Glu Ile Xaa' Cys Xaa' Ala Tyr Ala Ala Xaa' Cys Thr Xaa' Gly Cys | (SEQ ID NO: 3863) |
| Pro Gly Thr Cys Gly Glu Ile Xaa' Cys Xaa' Ala Tyr Ala Ala Xaa' Cys Thr Gly Xaa' Cys | (SEQ ID NO: 3864) |
| Pro Gly Thr Cys Gly Glu Ile Xaa' Cys Xaa' Ala Tyr Ala Ala Xaa' Cys Thr Gly Cys Xaa' | (SEQ ID NO: 3865) |
| Pro Gly Thr Cys Gly Glu Ile Xaa' Cys Xaa' Ala Tyr Ala Ala Ala Xaa' Thr Gly Cys | (SEQ ID NO: 3866) |
| Pro Gly Thr Cys Gly Glu Ile Xaa' Cys Xaa' Ala Tyr Ala Ala Ala Xaa' Cys Thr Gly Cys | (SEQ ID NO: 3867) |
| Pro Gly Thr Cys Gly Glu Ile Xaa' Cys Xaa' Ala Tyr Ala Ala Ala Xaa' Cys Xaa' Thr Gly Cys | (SEQ ID NO: 3868) |
| Pro Gly Thr Cys Gly Glu Ile Xaa' Cys Xaa' Ala Tyr Ala Ala Ala Xaa' Cys Thr Xaa' Gly Cys | (SEQ ID NO: 3869) |
| Pro Gly Thr Cys Gly Glu Ile Xaa' Cys Xaa' Ala Tyr Ala Ala Ala Xaa' Cys Thr Gly Xaa' Cys | (SEQ ID NO: 3870) |
| Pro Gly Thr Cys Gly Glu Ile Xaa' Cys Xaa' Ala Tyr Ala Ala Ala Xaa' Cys Thr Gly Cys Xaa' | (SEQ ID NO: 3871) |
| Pro Gly Thr Cys Gly Glu Ile Xaa' Cys Xaa' Ala Tyr Ala Ala Ala Cys Xaa' Thr Gly Cys | (SEQ ID NO: 3872) |
| Pro Gly Thr Cys Gly Glu Ile Xaa' Cys Xaa' Ala Tyr Ala Ala Ala Cys Xaa' Xaa' Thr Gly Cys | (SEQ ID NO: 3873) |
| Pro Gly Thr Cys Gly Glu Ile Xaa' Cys Xaa' Ala Tyr Ala Ala Ala Cys Xaa' Thr Xaa' Gly Cys | (SEQ ID NO: 3874) |
| Pro Gly Thr Cys Gly Glu Ile Xaa' Cys Xaa' Ala Tyr Ala Ala Ala Cys Xaa' Thr Gly Xaa' Cys | (SEQ ID NO: 3875) |
| Pro Gly Thr Cys Gly Glu Ile Xaa' Cys Xaa' Ala Tyr Ala Ala Ala Cys Xaa' Thr Gly Cys Xaa' | (SEQ ID NO: 3876) |
| Pro Gly Thr Cys Gly Glu Ile Xaa' Cys Xaa' Ala Tyr Ala Ala Ala Cys Thr Xaa' Gly Cys | (SEQ ID NO: 3877) |
| Pro Gly Thr Cys Gly Glu Ile Xaa' Cys Xaa' Ala Tyr Ala Ala Ala Cys Thr Xaa' Xaa' Gly Cys | (SEQ ID NO: 3878) |
| Pro Gly Thr Cys Gly Glu Ile Xaa' Cys Xaa' Ala Tyr Ala Ala Ala Cys Thr Xaa' Gly Xaa' Cys | (SEQ ID NO: 3879) |
| Pro Gly Thr Cys Gly Glu Ile Xaa' Cys Xaa' Ala Tyr Ala Ala Ala Cys Thr Xaa' Gly Cys Xaa' | (SEQ ID NO: 3880) |

FIG. 2

| | | | | | | | | | | |
|---|---|---|---|---|---|---|---|---|---|---|
| Pro Gly Thr Cys Gly Glu Ile Xaa' Cys Xaa' Ala Tyr Ala Ala Cys Thr Gly Xaa' Cys | (SEQ ID NO: 3881) |
| Pro Gly Thr Cys Gly Glu Ile Xaa' Cys Xaa' Ala Tyr Ala Ala Cys Thr Gly Xaa' Xaa' Cys | (SEQ ID NO: 3882) |
| Pro Gly Thr Cys Gly Glu Ile Xaa' Cys Xaa' Ala Tyr Ala Ala Cys Thr Gly Xaa' Cys Xaa' | (SEQ ID NO: 3883) |
| Pro Gly Thr Cys Gly Glu Ile Xaa' Cys Xaa' Ala Tyr Ala Ala Cys Thr Gly Cys Xaa' | (SEQ ID NO: 3884) |
| Pro Gly Thr Cys Gly Glu Ile Xaa' Cys Xaa' Ala Tyr Ala Ala Xaa' Cys Thr Gly Cys Xaa' Xaa' | (SEQ ID NO: 3885) |
| Pro Gly Thr Cys Gly Glu Ile Xaa' Cys Ala Xaa' Tyr Ala Ala Xaa' Cys Thr Gly Cys | (SEQ ID NO: 3886) |
| Pro Gly Thr Cys Gly Glu Ile Xaa' Cys Ala Xaa' Xaa' Tyr Ala Ala Cys Thr Gly Cys | (SEQ ID NO: 3887) |
| Pro Gly Thr Cys Gly Glu Ile Xaa' Cys Ala Xaa' Xaa' Tyr Ala Ala Cys Thr Ala Cys Thr Gly Cys | (SEQ ID NO: 3888) |
| Pro Gly Thr Cys Gly Glu Ile Xaa' Cys Xaa' Ala Xaa' Tyr Ala Ala Cys Thr Gly Cys | (SEQ ID NO: 3889) |
| Pro Gly Thr Cys Gly Glu Ile Xaa' Cys Xaa' Ala Xaa' Tyr Xaa' Ala Ala Cys Thr Gly Cys | (SEQ ID NO: 3890) |
| Pro Gly Thr Cys Gly Glu Ile Xaa' Cys Xaa' Ala Xaa' Tyr Ala Ala Xaa' Cys Thr Gly Cys | (SEQ ID NO: 3891) |
| Pro Gly Thr Cys Gly Glu Ile Xaa' Cys Xaa' Ala Xaa' Tyr Ala Ala Cys Xaa' Thr Gly Cys | (SEQ ID NO: 3892) |
| Pro Gly Thr Cys Gly Glu Ile Xaa' Cys Xaa' Ala Xaa' Tyr Ala Ala Cys Thr Xaa' Gly Cys | (SEQ ID NO: 3893) |
| Pro Gly Thr Cys Gly Glu Ile Xaa' Cys Xaa' Ala Xaa' Tyr Ala Ala Cys Thr Gly Xaa' Cys | (SEQ ID NO: 3894) |
| Pro Gly Thr Cys Gly Glu Ile Xaa' Cys Xaa' Ala Xaa' Tyr Ala Ala Cys Thr Gly Cys Xaa' | (SEQ ID NO: 3895) |
| Pro Gly Thr Cys Gly Glu Ile Xaa' Cys Xaa' Ala Xaa' Tyr Xaa' Ala Ala Cys Thr Gly Cys | (SEQ ID NO: 3896) |
| Pro Gly Thr Cys Gly Glu Ile Xaa' Cys Xaa' Ala Xaa' Tyr Xaa' Ala Xaa' Ala Cys Thr Gly Cys | (SEQ ID NO: 3897) |
| Pro Gly Thr Cys Gly Glu Ile Xaa' Cys Xaa' Ala Xaa' Tyr Xaa' Ala Xaa' Ala Cys Thr Gly Cys | (SEQ ID NO: 3898) |
| Pro Gly Thr Cys Gly Glu Ile Xaa' Cys Xaa' Ala Xaa' Tyr Xaa' Ala Xaa' Ala Cys Xaa' Thr Gly Cys | (SEQ ID NO: 3899) |
| Pro Gly Thr Cys Gly Glu Ile Xaa' Cys Xaa' Ala Xaa' Tyr Xaa' Ala Xaa' Ala Cys Thr Xaa' Gly Cys | (SEQ ID NO: 3900) |
| Pro Gly Thr Cys Gly Glu Ile Xaa' Cys Xaa' Ala Xaa' Tyr Xaa' Ala Xaa' Ala Cys Thr Gly Xaa' Cys | (SEQ ID NO: 3901) |
| Pro Gly Thr Cys Gly Glu Ile Xaa' Cys Xaa' Ala Xaa' Tyr Xaa' Ala Xaa' Ala Cys Thr Gly Cys Xaa' | (SEQ ID NO: 3902) |
| Pro Gly Thr Cys Gly Glu Ile Xaa' Cys Xaa' Ala Xaa' Tyr Ala Xaa' Ala Cys Thr Gly Cys | (SEQ ID NO: 3903) |
| Pro Gly Thr Cys Gly Glu Ile Xaa' Cys Xaa' Ala Xaa' Tyr Ala Xaa' Ala Xaa' Cys Thr Gly Cys | (SEQ ID NO: 3904) |
| Pro Gly Thr Cys Gly Glu Ile Xaa' Cys Xaa' Ala Xaa' Tyr Ala Xaa' Ala Cys Xaa' Thr Gly Cys | (SEQ ID NO: 3905) |
| Pro Gly Thr Cys Gly Glu Ile Xaa' Cys Xaa' Ala Xaa' Tyr Ala Xaa' Ala Cys Thr Xaa' Gly Cys | (SEQ ID NO: 3906) |
| Pro Gly Thr Cys Gly Glu Ile Xaa' Cys Xaa' Ala Xaa' Tyr Ala Xaa' Ala Cys Thr Gly Xaa' Cys | (SEQ ID NO: 3907) |
| Pro Gly Thr Cys Gly Glu Ile Xaa' Cys Xaa' Ala Xaa' Tyr Ala Xaa' Ala Cys Thr Gly Cys Xaa' | (SEQ ID NO: 3908) |
| Pro Gly Thr Cys Gly Glu Ile Xaa' Cys Xaa' Ala Xaa' Tyr Ala Ala Xaa' Cys Thr Gly Cys | (SEQ ID NO: 3909) |
| Pro Gly Thr Cys Gly Glu Ile Xaa' Cys Xaa' Ala Xaa' Tyr Ala Ala Xaa' Cys Xaa' Thr Gly Cys | (SEQ ID NO: 3910) |
| Pro Gly Thr Cys Gly Glu Ile Xaa' Cys Xaa' Ala Xaa' Tyr Ala Ala Xaa' Cys Thr Xaa' Gly Cys | (SEQ ID NO: 3911) |
| Pro Gly Thr Cys Gly Glu Ile Xaa' Cys Xaa' Ala Xaa' Tyr Ala Ala Xaa' Cys Thr Gly Xaa' Cys | (SEQ ID NO: 3912) |
| Pro Gly Thr Cys Gly Glu Ile Xaa' Cys Ala Xaa' Tyr Ala Ala Xaa' Cys Xaa' Thr Gly Cys | (SEQ ID NO: 3913) |
| Pro Gly Thr Cys Gly Glu Ile Xaa' Cys Ala Xaa' Tyr Ala Ala Xaa' Cys Thr Xaa' Gly Cys | (SEQ ID NO: 3914) |

FIG. 2

| | | | | | | | | | | | | |
|---|---|---|---|---|---|---|---|---|---|---|---|---|
| Pro Gly Thr Cys Gly Glu Ile Xaa' Cys Ala Xaa' Tyr Ala Ala Xaa' Cys Thr Gly Xaa' Cys | (SEQ ID NO: 3915) |
| Pro Gly Thr Cys Gly Glu Ile Xaa' Cys Ala Xaa' Tyr Ala Ala Xaa' Cys Thr Gly Cys Xaa' | (SEQ ID NO: 3916) |
| Pro Gly Thr Cys Gly Glu Ile Xaa' Cys Ala Xaa' Tyr Ala Ala Cys Xaa' Thr Gly Cys | (SEQ ID NO: 3917) |
| Pro Gly Thr Cys Gly Glu Ile Xaa' Cys Ala Xaa' Tyr Ala Ala Cys Xaa' Thr Gly Gly Cys | (SEQ ID NO: 3918) |
| Pro Gly Thr Cys Gly Glu Ile Xaa' Cys Ala Xaa' Tyr Ala Ala Cys Xaa' Thr Xaa' Gly Cys | (SEQ ID NO: 3919) |
| Pro Gly Thr Cys Gly Glu Ile Xaa' Cys Ala Xaa' Tyr Ala Ala Cys Xaa' Thr Gly Xaa' Cys | (SEQ ID NO: 3920) |
| Pro Gly Thr Cys Gly Glu Ile Xaa' Cys Ala Xaa' Tyr Ala Ala Cys Xaa' Thr Gly Cys Xaa' | (SEQ ID NO: 3921) |
| Pro Gly Thr Cys Gly Glu Ile Xaa' Cys Ala Xaa' Tyr Ala Ala Cys Thr Xaa' Gly Cys | (SEQ ID NO: 3922) |
| Pro Gly Thr Cys Gly Glu Ile Xaa' Cys Ala Xaa' Tyr Ala Ala Cys Thr Xaa' Xaa' Gly Cys | (SEQ ID NO: 3923) |
| Pro Gly Thr Cys Gly Glu Ile Xaa' Cys Ala Xaa' Tyr Ala Ala Cys Thr Xaa' Gly Xaa' Cys | (SEQ ID NO: 3924) |
| Pro Gly Thr Cys Gly Glu Ile Xaa' Cys Ala Xaa' Tyr Ala Ala Cys Thr Xaa' Gly Cys Xaa' | (SEQ ID NO: 3925) |
| Pro Gly Thr Cys Gly Glu Ile Xaa' Cys Ala Xaa' Tyr Ala Ala Cys Thr Gly Xaa' Cys | (SEQ ID NO: 3926) |
| Pro Gly Thr Cys Gly Glu Ile Xaa' Cys Ala Xaa' Tyr Ala Ala Cys Thr Gly Xaa' Xaa' Cys | (SEQ ID NO: 3927) |
| Pro Gly Thr Cys Gly Glu Ile Xaa' Cys Ala Xaa' Tyr Ala Ala Cys Thr Gly Xaa' Cys Xaa' | (SEQ ID NO: 3928) |
| Pro Gly Thr Cys Gly Glu Ile Xaa' Cys Ala Xaa' Tyr Ala Ala Cys Thr Gly Cys Xaa' | (SEQ ID NO: 3929) |
| Pro Gly Thr Cys Gly Glu Ile Xaa' Cys Ala Xaa' Tyr Ala Ala Cys Thr Gly Cys Xaa' Xaa' | (SEQ ID NO: 3930) |
| Pro Gly Thr Cys Gly Glu Ile Xaa' Cys Ala Tyr Xaa' Xaa' Ala Ala Cys Thr Gly Cys | (SEQ ID NO: 3931) |
| Pro Gly Thr Cys Gly Glu Ile Xaa' Cys Ala Tyr Xaa' Xaa' Ala Ala Cys Thr Gly Gly Cys | (SEQ ID NO: 3932) |
| Pro Gly Thr Cys Gly Glu Ile Xaa' Cys Ala Tyr Xaa' Xaa' Ala Ala Xaa' Ala Cys Thr Gly Cys | (SEQ ID NO: 3933) |
| Pro Gly Thr Cys Gly Glu Ile Xaa' Cys Ala Tyr Xaa' Xaa' Ala Ala Xaa' Ala Cys Thr Gly Gly Cys | (SEQ ID NO: 3934) |
| Pro Gly Thr Cys Gly Glu Ile Xaa' Cys Ala Tyr Xaa' Xaa' Ala Xaa' Ala Cys Thr Gly Cys | (SEQ ID NO: 3935) |
| Pro Gly Thr Cys Gly Glu Ile Xaa' Cys Ala Tyr Xaa' Xaa' Ala Xaa' Ala Cys Thr Gly Gly Cys | (SEQ ID NO: 3936) |
| Pro Gly Thr Cys Gly Glu Ile Xaa' Cys Ala Tyr Xaa' Xaa' Ala Ala Xaa' Cys Thr Gly Cys | (SEQ ID NO: 3937) |
| Pro Gly Thr Cys Gly Glu Ile Xaa' Cys Ala Tyr Xaa' Xaa' Ala Ala Xaa' Cys Thr Gly Gly Cys | (SEQ ID NO: 3938) |
| Pro Gly Thr Cys Gly Glu Ile Xaa' Cys Ala Tyr Xaa' Ala Xaa' Ala Cys Thr Gly Xaa' Cys | (SEQ ID NO: 3939) |
| Pro Gly Thr Cys Gly Glu Ile Xaa' Cys Ala Tyr Xaa' Ala Xaa' Ala Cys Thr Gly Cys Xaa' | (SEQ ID NO: 3940) |
| Pro Gly Thr Cys Gly Glu Ile Xaa' Cys Ala Tyr Xaa' Ala Ala Xaa' Cys Thr Gly Cys | (SEQ ID NO: 3941) |
| Pro Gly Thr Cys Gly Glu Ile Xaa' Cys Ala Tyr Xaa' Ala Ala Xaa' Cys Thr Gly Gly Cys | (SEQ ID NO: 3942) |
| Pro Gly Thr Cys Gly Glu Ile Xaa' Cys Ala Tyr Xaa' Ala Ala Xaa' Cys Xaa' Thr Gly Cys | (SEQ ID NO: 3943) |
| Pro Gly Thr Cys Gly Glu Ile Xaa' Cys Ala Tyr Xaa' Ala Ala Xaa' Cys Thr Xaa' Gly Cys | (SEQ ID NO: 3944) |
| Pro Gly Thr Cys Gly Glu Ile Xaa' Cys Ala Tyr Xaa' Ala Ala Xaa' Cys Thr Gly Xaa' Cys | (SEQ ID NO: 3945) |
| Pro Gly Thr Cys Gly Glu Ile Xaa' Cys Ala Tyr Xaa' Ala Ala Xaa' Cys Thr Gly Cys Xaa' | (SEQ ID NO: 3946) |
| Pro Gly Thr Cys Gly Glu Ile Ile Cys Ala Tyr Xaa' Ala Ala Xaa' Cys Thr Gly Cys | (SEQ ID NO: 3947) |
| Pro Gly Thr Cys Gly Glu Ile Xaa' Cys Ala Tyr Xaa' Ala Ala Xaa' Cys Thr Gly Cys | (SEQ ID NO: 3948) |

FIG. 2

Pro Gly Thr Cys Gly Glu Ile Xaa' Cys Ala Tyr Xaa' Ala Ala Xaa' Cys Xaa' Thr Gly Cys (SEQ ID NO: 3949)
Pro Gly Thr Cys Gly Glu Ile Xaa' Cys Ala Tyr Xaa' Ala Ala Xaa' Cys Thr Xaa' Gly Cys (SEQ ID NO: 3950)
Pro Gly Thr Cys Gly Glu Ile Xaa' Cys Ala Tyr Xaa' Ala Ala Xaa' Cys Thr Gly Xaa' Cys (SEQ ID NO: 3951)
Pro Gly Thr Cys Gly Glu Ile Xaa' Cys Ala Tyr Xaa' Ala Ala Xaa' Cys Thr Gly Cys Xaa' (SEQ ID NO: 3952)
Pro Gly Thr Cys Gly Glu Ile Xaa' Cys Ala Tyr Xaa' Ala Ala Xaa' Cys Xaa' Thr Gly Cys (SEQ ID NO: 3953)
Pro Gly Thr Cys Gly Glu Ile Xaa' Cys Ala Tyr Xaa' Ala Ala Xaa' Cys Xaa' Thr Gly Cys (SEQ ID NO: 3954)
Pro Gly Thr Cys Gly Glu Ile Xaa' Cys Ala Tyr Xaa' Ala Ala Xaa' Cys Xaa' Thr Gly Cys (SEQ ID NO: 3955)
Pro Gly Thr Cys Gly Glu Ile Xaa' Cys Ala Tyr Xaa' Ala Ala Xaa' Cys Xaa' Thr Gly Cys (SEQ ID NO: 3956)
Pro Gly Thr Cys Gly Glu Ile Xaa' Cys Ala Tyr Xaa' Ala Ala Xaa' Cys Xaa' Thr Gly Cys (SEQ ID NO: 3957)
Pro Gly Thr Cys Gly Glu Ile Xaa' Cys Ala Tyr Xaa' Ala Ala Xaa' Cys Thr Xaa' Gly Cys (SEQ ID NO: 3958)
Pro Gly Thr Cys Gly Glu Ile Xaa' Cys Ala Tyr Xaa' Ala Ala Xaa' Cys Thr Xaa' Gly Cys (SEQ ID NO: 3959)
Pro Gly Thr Cys Gly Glu Ile Xaa' Cys Ala Tyr Xaa' Ala Ala Xaa' Cys Thr Xaa' Gly Cys (SEQ ID NO: 3960)
Pro Gly Thr Cys Gly Glu Ile Xaa' Cys Ala Tyr Xaa' Ala Ala Xaa' Cys Thr Gly Xaa' Cys (SEQ ID NO: 3961)
Pro Gly Thr Cys Gly Glu Ile Xaa' Cys Ala Tyr Xaa' Ala Ala Xaa' Cys Thr Gly Xaa' Cys (SEQ ID NO: 3962)
Pro Gly Thr Cys Gly Glu Ile Xaa' Cys Ala Tyr Xaa' Ala Ala Xaa' Cys Thr Gly Cys Xaa' (SEQ ID NO: 3963)
Pro Gly Thr Cys Gly Glu Ile Xaa' Cys Ala Tyr Xaa' Ala Ala Xaa' Cys Thr Gly Xaa' Cys (SEQ ID NO: 3964)
Pro Gly Thr Cys Gly Glu Ile Xaa' Cys Ala Tyr Xaa' Ala Ala Xaa' Cys Thr Gly Cys Xaa' (SEQ ID NO: 3965)
Pro Gly Thr Cys Gly Glu Ile Xaa' Cys Ala Tyr Xaa' Ala Ala Xaa' Cys Thr Gly Cys Xaa' (SEQ ID NO: 3966)
Pro Gly Thr Cys Gly Glu Ile Xaa' Cys Ala Tyr Ala Xaa' Ala Xaa' Cys Thr Gly Cys (SEQ ID NO: 3967)
Pro Gly Thr Cys Gly Glu Ile Xaa' Cys Ala Tyr Ala Xaa' Ala Xaa' Cys Ala Thr Gly Cys (SEQ ID NO: 3968)
Pro Gly Thr Cys Gly Glu Ile Xaa' Cys Ala Tyr Ala Xaa' Xaa' Ala Xaa' Cys Thr Gly Cys (SEQ ID NO: 3969)
Pro Gly Thr Cys Gly Glu Ile Xaa' Cys Ala Tyr Ala Xaa' Xaa' Ala Xaa' Cys Thr Gly Cys (SEQ ID NO: 3970)
Pro Gly Thr Cys Gly Glu Ile Xaa' Cys Ala Tyr Ala Xaa' Xaa' Ala Xaa' Cys Thr Gly Cys (SEQ ID NO: 3971)
Pro Gly Thr Cys Gly Glu Ile Xaa' Cys Ala Tyr Ala Xaa' Ala Xaa' Cys Ala Thr Gly Cys (SEQ ID NO: 3972)
Pro Gly Thr Cys Gly Glu Ile Xaa' Cys Ala Tyr Ala Xaa' Ala Xaa' Cys Ala Thr Gly Cys (SEQ ID NO: 3973)
Pro Gly Thr Cys Gly Glu Ile Xaa' Cys Ala Tyr Ala Xaa' Ala Xaa' Cys Ala Thr Gly Cys (SEQ ID NO: 3974)
Pro Gly Thr Cys Gly Glu Ile Xaa' Cys Ala Tyr Ala Xaa' Ala Xaa' Cys Thr Gly Xaa' Cys (SEQ ID NO: 3975)
Pro Gly Thr Cys Gly Glu Ile Xaa' Cys Ala Tyr Ala Xaa' Ala Xaa' Cys Thr Gly Cys (SEQ ID NO: 3976)
Pro Gly Thr Cys Gly Glu Ile Xaa' Cys Ala Tyr Ala Xaa' Ala Xaa' Cys Xaa' Thr Gly Cys (SEQ ID NO: 3977)
Pro Gly Thr Cys Gly Glu Ile Xaa' Cys Ala Tyr Ala Xaa' Ala Xaa' Cys Thr Xaa' Gly Cys (SEQ ID NO: 3978)
Pro Gly Thr Cys Gly Glu Ile Xaa' Cys Ala Tyr Ala Xaa' Ala Xaa' Cys Thr Gly Xaa' Cys (SEQ ID NO: 3979)
Pro Gly Thr Cys Gly Glu Ile Xaa' Cys Ala Tyr Ala Xaa' Ala Xaa' Cys Thr Gly Cys Xaa' (SEQ ID NO: 3980)
Pro Gly Thr Cys Gly Glu Ile Xaa' Cys Ala Tyr Ala Xaa' Ala Cys Xaa' Thr Gly Cys (SEQ ID NO: 3981)
Pro Gly Thr Cys Gly Glu Ile Xaa' Cys Ala Tyr Ala Xaa' Ala Cys Xaa' Xaa' Thr Gly Cys (SEQ ID NO: 3982)

FIG. 2

| | | | | | | | | | | | |
|---|---|---|---|---|---|---|---|---|---|---|---|
| Pro | Gly | Thr | Cys | Gly | Glu | Ile | Xaa | Cys | Ala | Tyr | Ala | Xaa' | Ala | Cys | Xaa' | Thr | Xaa' | Gly | Cys | (SEQID NO: 3983) |
| Pro | Gly | Thr | Cys | Gly | Glu | Ile | Xaa | Cys | Ala | Tyr | Ala | Xaa' | Ala | Cys | Xaa' | Thr | Gly | Xaa' | Cys | (SEQID NO: 3984) |
| Pro | Gly | Thr | Cys | Gly | Glu | Ile | Xaa | Cys | Ala | Tyr | Ala | Xaa' | Ala | Cys | Xaa' | Thr | Gly | Cys | Xaa' | (SEQID NO: 3985) |
| Pro | Gly | Thr | Cys | Gly | Glu | Ile | Xaa | Cys | Ala | Tyr | Ala | Xaa' | Ala | Cys | Thr | Xaa' | Gly | Cys | | (SEQID NO: 3986) |
| Pro | Gly | Thr | Cys | Gly | Glu | Ile | Xaa | Cys | Ala | Tyr | Ala | Xaa' | Ala | Cys | Thr | Xaa' | Xaa' | Gly | Cys | (SEQID NO: 3987) |
| Pro | Gly | Thr | Cys | Gly | Glu | Ile | Xaa | Cys | Ala | Tyr | Ala | Xaa' | Ala | Cys | Thr | Xaa' | Gly | Xaa' | Cys | (SEQID NO: 3988) |
| Pro | Gly | Thr | Cys | Gly | Glu | Ile | Xaa | Cys | Ala | Tyr | Ala | Xaa' | Ala | Cys | Thr | Xaa' | Gly | Cys | Xaa' | (SEQID NO: 3989) |
| Pro | Gly | Thr | Cys | Gly | Glu | Ile | Xaa | Cys | Ala | Tyr | Ala | Xaa' | Ala | Cys | Thr | Gly | Xaa' | Cys | | (SEQID NO: 3990) |
| Pro | Gly | Thr | Cys | Gly | Glu | Ile | Xaa | Cys | Ala | Tyr | Ala | Xaa' | Ala | Cys | Thr | Gly | Xaa' | Xaa' | Cys | (SEQID NO: 3991) |
| Pro | Gly | Thr | Cys | Gly | Glu | Ile | Xaa | Cys | Ala | Tyr | Ala | Xaa' | Ala | Cys | Thr | Gly | Xaa' | Cys | Xaa' | (SEQID NO: 3992) |
| Pro | Gly | Thr | Cys | Gly | Glu | Ile | Xaa | Cys | Ala | Tyr | Ala | Xaa' | Ala | Cys | Thr | Gly | Cys | Xaa' | | (SEQID NO: 3993) |
| Pro | Gly | Thr | Cys | Gly | Glu | Ile | Xaa | Cys | Ala | Tyr | Ala | Xaa' | Ala | Cys | Thr | Gly | Cys | Xaa' | Xaa' | (SEQID NO: 3994) |
| Pro | Gly | Thr | Cys | Gly | Glu | Ile | Xaa | Cys | Ala | Tyr | Ala | Xaa' | Ala | Xaa' | Cys | Thr | Gly | Cys | | (SEQID NO: 3995) |
| Pro | Gly | Thr | Cys | Gly | Glu | Ile | Xaa | Cys | Ala | Tyr | Ala | Ala | Xaa' | Cys | Thr | Gly | Cys | | | (SEQID NO: 3996) |
| Pro | Gly | Thr | Cys | Gly | Glu | Ile | Xaa | Cys | Ala | Tyr | Ala | Ala | Xaa' | Cys | Xaa' | Thr | Gly | Cys | | (SEQID NO: 3997) |
| Pro | Gly | Thr | Cys | Gly | Glu | Ile | Xaa | Cys | Ala | Tyr | Ala | Ala | Xaa' | Cys | Xaa' | Xaa' | Thr | Gly | Cys | (SEQID NO: 3998) |
| Pro | Gly | Thr | Cys | Gly | Glu | Ile | Xaa | Cys | Ala | Tyr | Ala | Ala | Xaa' | Cys | Xaa' | Thr | Xaa' | Gly | Cys | (SEQID NO: 3999) |
| Pro | Gly | Thr | Cys | Gly | Glu | Ile | Xaa | Cys | Ala | Tyr | Ala | Ala | Xaa' | Cys | Xaa' | Thr | Gly | Xaa' | Cys | (SEQID NO: 4000) |
| Pro | Gly | Thr | Cys | Gly | Glu | Ile | Xaa | Cys | Ala | Tyr | Ala | Ala | Xaa' | Cys | Xaa' | Thr | Gly | Cys | Xaa' | (SEQID NO: 4001) |
| Pro | Gly | Thr | Cys | Gly | Glu | Ile | Xaa | Cys | Ala | Tyr | Ala | Ala | Xaa' | Cys | Thr | Xaa' | Gly | Cys | | (SEQID NO: 4002) |
| Pro | Gly | Thr | Cys | Gly | Glu | Ile | Xaa | Cys | Ala | Tyr | Ala | Ala | Xaa' | Cys | Thr | Xaa' | Xaa' | Gly | Cys | (SEQID NO: 4003) |
| Pro | Gly | Thr | Cys | Gly | Glu | Ile | Xaa | Cys | Ala | Tyr | Ala | Ala | Xaa' | Cys | Thr | Xaa' | Gly | Xaa' | Cys | (SEQID NO: 4004) |
| Pro | Gly | Thr | Cys | Gly | Glu | Ile | Xaa | Cys | Ala | Tyr | Ala | Ala | Xaa' | Cys | Thr | Xaa' | Gly | Cys | Xaa' | (SEQID NO: 4005) |
| Pro | Gly | Thr | Cys | Gly | Glu | Ile | Xaa | Cys | Ala | Tyr | Ala | Ala | Xaa' | Cys | Thr | Gly | Xaa' | Cys | | (SEQID NO: 4006) |
| Pro | Gly | Thr | Cys | Gly | Glu | Ile | Xaa | Cys | Ala | Tyr | Ala | Ala | Xaa' | Cys | Thr | Gly | Xaa' | Xaa' | Cys | (SEQID NO: 4007) |
| Pro | Gly | Thr | Cys | Gly | Glu | Ile | Xaa | Cys | Ala | Tyr | Ala | Ala | Xaa' | Cys | Thr | Gly | Xaa' | Cys | Xaa' | (SEQID NO: 4008) |
| Pro | Gly | Thr | Cys | Gly | Glu | Ile | Xaa | Cys | Ala | Tyr | Ala | Ala | Xaa' | Cys | Thr | Gly | Cys | Xaa' | | (SEQID NO: 4009) |
| Pro | Gly | Thr | Cys | Gly | Glu | Ile | Xaa | Cys | Ala | Tyr | Ala | Ala | Xaa' | Cys | Thr | Gly | Cys | Xaa' | Xaa' | (SEQID NO: 4010) |
| Pro | Gly | Thr | Cys | Gly | Glu | Ile | Xaa | Cys | Ala | Tyr | Ala | Ala | Ala | Xaa' | Cys | Thr | Gly | Cys | | (SEQID NO: 4011) |
| Pro | Gly | Thr | Cys | Gly | Glu | Ile | Xaa | Cys | Ala | Tyr | Ala | Ala | Ala | Xaa' | Cys | Xaa' | Thr | Gly | Cys | (SEQID NO: 4012) |
| Pro | Gly | Thr | Cys | Gly | Glu | Ile | Xaa | Cys | Ala | Tyr | Ala | Ala | Ala | Xaa' | Cys | Thr | Xaa' | Gly | Cys | (SEQID NO: 4013) |
|

| | | | | | | | | | | | | | | |
|---|---|---|---|---|---|---|---|---|---|---|---|---|---|---|
| Pro Gly Thr Cys Gly Glu Ile Xaa' Cys Ala Tyr Ala Ala Cys Xaa' Xaa' Thr Gly Cys | (SEQID NO: 4017) |
| Pro Gly Thr Cys Gly Glu Ile Ile Xaa' Cys Ala Ala Tyr Ala Ala Cys Xaa' Xaa' Xaa' Thr Gly Cys | (SEQID NO: 4018) |
| Pro Gly Thr Cys Gly Glu Ile Ile Xaa' Cys Ala Ala Tyr Ala Ala Cys Xaa' Xaa' Xaa' Thr Xaa' Gly Cys | (SEQID NO: 4019) |
| Pro Gly Thr Cys Gly Glu Ile Ile Xaa' Cys Ala Ala Tyr Ala Ala Cys Xaa' Xaa' Xaa' Xaa' Thr Gly Xaa' Cys | (SEQID NO: 4020) |
| Pro Gly Thr Cys Gly Glu Ile Ile Xaa' Cys Ala Ala Tyr Ala Ala Cys Xaa' Xaa' Xaa' Xaa' Thr Gly Cys Xaa' | (SEQID NO: 4021) |
| Pro Gly Thr Cys Gly Glu Ile Ile Xaa' Cys Ala Ala Tyr Ala Ala Cys Xaa' Xaa' Xaa' Xaa' Thr Xaa' Gly Cys | (SEQID NO: 4022) |
| Pro Gly Thr Cys Gly Glu Ile Ile Xaa' Cys Ala Ala Tyr Ala Ala Cys Xaa' Xaa' Xaa' Xaa' Thr Xaa' Gly Xaa' Cys | (SEQID NO: 4023) |
| Pro Gly Thr Cys Gly Glu Ile Ile Xaa' Cys Ala Ala Tyr Ala Ala Cys Xaa' Xaa' Xaa' Xaa' Thr Xaa' Gly Cys Xaa' | (SEQID NO: 4024) |
| Pro Gly Thr Cys Gly Glu Ile Ile Xaa' Cys Ala Ala Tyr Ala Ala Cys Xaa' Xaa' Xaa' Xaa' Thr Xaa' Gly Xaa' Cys Xaa' | (SEQID NO: 4025) |
| Pro Gly Thr Cys Gly Glu Ile Ile Xaa' Cys Ala Ala Tyr Ala Ala Cys Xaa' Xaa' Xaa' Xaa' Thr Gly Xaa' Cys | (SEQID NO: 4026) |
| Pro Gly Thr Cys Gly Glu Ile Ile Xaa' Cys Ala Ala Tyr Ala Ala Cys Xaa' Xaa' Xaa' Xaa' Thr Gly Xaa' Xaa' Cys | (SEQID NO: 4027) |
| Pro Gly Thr Cys Gly Glu Ile Ile Xaa' Cys Ala Ala Tyr Ala Ala Cys Xaa' Xaa' Xaa' Xaa' Thr Gly Xaa' Cys Xaa' | (SEQID NO: 4028) |
| Pro Gly Thr Cys Gly Glu Ile Ile Xaa' Cys Ala Ala Tyr Ala Ala Cys Xaa' Xaa' Xaa' Xaa' Thr Gly Cys Xaa' | (SEQID NO: 4029) |
| Pro Gly Thr Cys Gly Glu Ile Ile Xaa' Cys Ala Ala Tyr Ala Ala Cys Xaa' Xaa' Xaa' Thr Gly Cys | (SEQID NO: 4030) |
| Pro Gly Thr Cys Gly Glu Ile Ile Xaa' Cys Ala Ala Tyr Ala Ala Cys Xaa' Xaa' Thr Gly Cys | (SEQID NO: 4031) |
| Pro Gly Thr Cys Gly Glu Ile Ile Xaa' Cys Ala Ala Tyr Ala Ala Cys Xaa' Xaa' Xaa' Thr Xaa' Gly Cys | (SEQID NO: 4032) |
| Pro Gly Thr Cys Gly Glu Ile Ile Xaa' Cys Ala Ala Tyr Ala Ala Cys Xaa' Xaa' Xaa' Thr Xaa' Gly Xaa' Cys | (SEQID NO: 4033) |
| Pro Gly Thr Cys Gly Glu Ile Ile Xaa' Cys Ala Ala Tyr Ala Ala Cys Xaa' Xaa' Xaa' Thr Xaa' Gly Cys Xaa' | (SEQID NO: 4034) |
| Pro Gly Thr Cys Gly Glu Ile Ile Xaa' Cys Ala Ala Tyr Ala Ala Cys Xaa' Xaa' Xaa' Thr Xaa' Gly Xaa' Cys | (SEQID NO: 4035) |
| Pro Gly Thr Cys Gly Glu Ile Ile Xaa' Cys Ala Ala Tyr Ala Ala Cys Xaa' Xaa' Xaa' Thr Xaa' Gly Cys Xaa' | (SEQID NO: 4036) |
| Pro Gly Thr Cys Gly Glu Ile Ile Xaa' Cys Ala Ala Tyr Ala Ala Cys Xaa' Xaa' Xaa' Thr Gly Xaa' Xaa' Cys | (SEQID NO: 4037) |
| Pro Gly Thr Cys Gly Glu Ile Ile Xaa' Cys Ala Ala Tyr Ala Ala Cys Xaa' Xaa' Xaa' Thr Gly Xaa' Cys Xaa' | (SEQID NO: 4038) |
| Pro Gly Thr Cys Gly Glu Ile Ile Xaa' Cys Ala Ala Tyr Ala Ala Cys Xaa' Xaa' Thr Gly Xaa' Cys | (SEQID NO: 4039) |
| Pro Gly Thr Cys Gly Glu Ile Ile Xaa' Cys Ala Ala Tyr Ala Ala Cys Xaa' Xaa' Thr Gly Cys Xaa' | (SEQID NO: 4040) |
| Pro Gly Thr Cys Gly Glu Ile Ile Xaa' Cys Ala Ala Tyr Ala Ala Cys Xaa' Xaa' Thr Gly Xaa' Cys Xaa' | (SEQID NO: 4041) |
| Pro Gly Thr Cys Gly Glu Ile Ile Xaa' Cys Ala Ala Tyr Ala Ala Cys Xaa' Xaa' Thr Gly Xaa' Xaa' Cys | (SEQID NO: 4042) |
| Pro Gly Thr Cys Gly Glu Ile Ile Xaa' Cys Ala Ala Tyr Ala Ala Cys Xaa' Xaa' Thr Gly Xaa' Xaa' Cys Xaa' | (SEQID NO: 4043) |
| Pro Gly Thr Cys Gly Glu Ile Ile Xaa' Cys Ala Ala Tyr Ala Ala Cys Xaa' Xaa' Thr Gly Xaa' Cys Xaa' | (SEQID NO: 4044) |
| Pro Gly Thr Cys Gly Glu Ile Ile Xaa' Cys Ala Ala Tyr Ala Ala Cys Xaa' Xaa' Thr Gly Cys Xaa' | (SEQID NO: 4045) |
| Pro Gly Thr Cys Gly Glu Ile Ile Xaa' Cys Ala Ala Tyr Ala Ala Cys Xaa' Thr Gly Xaa' Cys Xaa' | (SEQID NO: 4046) |
| Pro Gly Thr Cys Gly Glu Ile Ile Xaa' Cys Ala Ala Tyr Ala Ala Cys Xaa' Thr Gly Cys Xaa' | (SEQID NO: 4047) |
| Pro Gly Thr Cys Gly Glu Ile Ile Cys Ala Ala Tyr Ala Ala Cys Thr Gly Cys Xaa' Xaa' | (SEQID NO: 4048) |
| Pro Gly Thr Cys Gly Glu Ile Cys Xaa' Ala Ala Tyr Ala Ala Cys Thr Gly Cys Xaa' Xaa' | (SEQID NO: 4049) |
| Pro Gly Thr Cys Gly Glu Ile Ile Cys Xaa' Ala Tyr Ala Ala Ala Cys Thr Gly Cys | (SEQID NO: 4050) |

FIG. 2

| | | | | | | | | | | | | |
|---|---|---|---|---|---|---|---|---|---|---|---|---|
| Pro | Gly | Thr | Cys | Gly | Glu | Ile | Cys | Xaa | Xaa' | Ala | Tyr | Ala Ala Cys Thr Gly Cys | (SEQ ID NO: 4051) |
| Pro | Gly | Thr | Cys | Gly | Glu | Ile | Cys | Xaa | Xaa' | Xaa | Ala | Tyr Ala Ala Cys Thr Gly Cys | (SEQ ID NO: 4052) |
| Pro | Gly | Thr | Cys | Gly | Glu | Ile | Cys | Xaa | Xaa' | Xaa | Ala | Tyr Ala Ala Cys Thr Gly Cys | (SEQ ID NO: 4053) |
| Pro | Gly | Thr | Cys | Gly | Glu | Ile | Cys | Xaa | Xaa' | Xaa | Ala | Xaa' Ala Tyr Ala Ala Cys Thr Gly Cys | (SEQ ID NO: 4054) |
| Pro | Gly | Thr | Cys | Gly | Glu | Ile | Cys | Xaa | Xaa' | Xaa | Ala | Tyr Xaa' Ala Ala Cys Thr Gly Cys | (SEQ ID NO: 4055) |
| Pro | Gly | Thr | Cys | Gly | Glu | Ile | Cys | Xaa | Xaa' | Xaa | Ala | Tyr Ala Xaa' Ala Cys Thr Gly Cys | (SEQ ID NO: 4056) |
| Pro | Gly | Thr | Cys | Gly | Glu | Ile | Cys | Xaa | Xaa' | Xaa | Ala | Tyr Ala Ala Xaa' Cys Thr Gly Cys | (SEQ ID NO: 4057) |
| Pro | Gly | Thr | Cys | Gly | Glu | Ile | Cys | Xaa | Xaa' | Xaa | Ala | Tyr Ala Ala Xaa' Cys Thr Gly Cys | (SEQ ID NO: 4058) |
| Pro | Gly | Thr | Cys | Gly | Glu | Ile | Cys | Xaa | Xaa' | Xaa | Ala | Tyr Ala Ala Cys Xaa' Thr Gly Cys | (SEQ ID NO: 4059) |
| Pro | Gly | Thr | Cys | Gly | Glu | Ile | Cys | Xaa | Xaa' | Xaa | Ala | Tyr Ala Ala Cys Thr Xaa' Gly Cys | (SEQ ID NO: 4060) |
| Pro | Gly | Thr | Cys | Gly | Glu | Ile | Cys | Xaa | Xaa' | Xaa | Ala | Tyr Ala Ala Cys Thr Gly Xaa' Cys | (SEQ ID NO: 4061) |
| Pro | Gly | Thr | Cys | Gly | Glu | Ile | Cys | Xaa | Xaa' | Xaa | Ala | Tyr Ala Ala Cys Thr Gly Cys Xaa' | (SEQ ID NO: 4062) |
| Pro | Gly | Thr | Cys | Gly | Glu | Ile | Cys | Xaa | Xaa' | Ala | Xaa' | Tyr Ala Ala Cys Thr Gly Cys | (SEQ ID NO: 4063) |
| Pro | Gly | Thr | Cys | Gly | Glu | Ile | Cys | Xaa | Xaa' | Ala | Xaa' | Tyr Ala Ala Cys Thr Gly Cys | (SEQ ID NO: 4064) |
| Pro | Gly | Thr | Cys | Gly | Glu | Ile | Cys | Xaa | Xaa' | Ala | Xaa' | Tyr Ala Ala Cys Thr Gly Cys | (SEQ ID NO: 4065) |
| Pro | Gly | Thr | Cys | Gly | Glu | Ile | Cys | Xaa | Xaa' | Ala | Xaa' | Tyr Ala Xaa' Ala Cys Thr Gly Cys | (SEQ ID NO: 4066) |
| Pro | Gly | Thr | Cys | Gly | Glu | Ile | Cys | Xaa | Xaa' | Ala | Xaa' | Tyr Ala Ala Xaa' Cys Thr Gly Cys | (SEQ ID NO: 4067) |
| Pro | Gly | Thr | Cys | Gly | Glu | Ile | Cys | Xaa | Xaa' | Ala | Xaa' | Tyr Ala Ala Cys Thr Gly Xaa' Cys | (SEQ ID NO: 4068) |
| Pro | Gly | Thr | Cys | Gly | Glu | Ile | Cys | Xaa | Xaa' | Ala | Xaa' | Tyr Ala Ala Cys Thr Gly Cys Xaa' | (SEQ ID NO: 4069) |
| Pro | Gly | Thr | Cys | Gly | Glu | Ile | Cys | Xaa | Xaa' | Ala | Tyr | Xaa' Ala Ala Cys Thr Gly Cys | (SEQ ID NO: 4070) |
| Pro | Gly | Thr | Cys | Gly | Glu | Ile | Cys | Xaa | Xaa' | Ala | Tyr | Xaa' Ala Ala Cys Thr Gly Cys | (SEQ ID NO: 4071) |
| Pro | Gly | Thr | Cys | Gly | Glu | Ile | Cys | Xaa | Xaa' | Ala | Tyr | Xaa' Ala Ala Ala Cys Thr Gly Cys | (SEQ ID NO: 4072) |
| Pro | Gly | Thr | Cys | Gly | Glu | Ile | Cys | Xaa | Xaa' | Ala | Tyr | Xaa' Ala Ala Cys Thr Gly Cys | (SEQ ID NO: 4073) |
| Pro | Gly | Thr | Cys | Gly | Glu | Ile | Cys | Xaa | Xaa' | Ala | Tyr | Xaa' Ala Xaa' Ala Cys Thr Gly Cys | (SEQ ID NO: 4074) |
| Pro | Gly | Thr | Cys | Gly | Glu | Ile | Cys | Xaa | Xaa' | Ala | Tyr | Xaa' Ala Ala Xaa' Cys Thr Gly Cys | (SEQ ID NO: 4075) |
| Pro | Gly | Thr | Cys | Gly | Glu | Ile | Cys | Xaa | Xaa' | Ala | Tyr | Xaa' Ala Ala Cys Thr Gly Xaa' Cys | (SEQ ID NO: 4076) |
| Pro | Gly | Thr | Cys | Gly | Glu | Ile | Cys | Xaa | Xaa' | Ala | Tyr | Xaa' Ala Ala Cys Thr Gly Xaa' Cys | (SEQ ID NO: 4077) |
| Pro | Gly | Thr | Cys | Gly | Glu | Ile | Cys | Xaa | Xaa' | Ala | Tyr | Xaa' Ala Ala Cys Thr Gly Cys Xaa' | (SEQ ID NO: 4078) |
| Pro | Gly | Thr | Cys | Gly | Glu | Ile | Cys | Xaa | Xaa' | Ala | Tyr | Ala Xaa' Ala Cys Thr Gly Cys | (SEQ ID NO: 4079) |
| Pro | Gly | Thr | Cys | Gly | Glu | Ile | Cys | Xaa | Xaa' | Ala | Tyr | Ala Xaa' Ala Cys Thr Gly Cys | (SEQ ID NO: 4080) |
| Pro | Gly | Thr | Cys | Gly | Glu | Ile | Cys | Xaa | Xaa' | Ala | Tyr | Ala Xaa' Ala Cys Thr Gly Cys | (SEQ ID NO: 4081) |
| Pro | Gly | Thr | Cys | Gly | Glu | Ile | Cys | Xaa | Xaa' | Ala | Tyr | Ala Xaa' Ala Xaa' Cys Thr Gly Cys | (SEQ ID NO: 4082) |
| Pro | Gly | Thr | Cys | Gly | Glu | Ile | Cys | Xaa | Xaa' | Ala | Tyr | Ala Xaa' Ala Cys Thr Gly Xaa' Cys | (SEQ ID NO: 4083) |
| Pro | Gly | Thr | Cys | Gly | Glu | Ile | Cys | Xaa | Xaa' | Ala | Tyr | Ala Cys Thr Gly Xaa' Cys | (SEQ ID NO: 4084) |

FIG. 2

| | | | | | | | | | | | | |
|---|---|---|---|---|---|---|---|---|---|---|---|---|
| Pro Gly Thr Cys Gly Glu Ile Cys Xaa' Ala Tyr Ala Xaa' Ala Cys Thr Gly Cys Xaa' | (SEQ ID NO: 4085) |
| Pro Gly Thr Cys Gly Glu Ile Cys Xaa' Ala Tyr Ala Ala Xaa' Cys Thr Gly Cys | (SEQ ID NO: 4086) |
| Pro Gly Thr Cys Gly Glu Ile Cys Xaa' Ala Tyr Ala Ala Xaa' Cys Thr Gly Cys | (SEQ ID NO: 4087) |
| Pro Gly Thr Cys Gly Glu Ile Cys Xaa' Ala Tyr Ala Ala Xaa' Cys Xaa' Thr Gly Cys | (SEQ ID NO: 4088) |
| Pro Gly Thr Cys Gly Glu Ile Cys Xaa' Ala Tyr Ala Ala Xaa' Cys Xaa' Thr Gly Cys | (SEQ ID NO: 4089) |
| Pro Gly Thr Cys Gly Glu Ile Cys Xaa' Ala Tyr Ala Ala Xaa' Cys Thr Xaa' Gly Cys | (SEQ ID NO: 4090) |
| Pro Gly Thr Cys Gly Glu Ile Cys Xaa' Ala Tyr Ala Ala Xaa' Cys Thr Gly Xaa' Cys | (SEQ ID NO: 4091) |
| Pro Gly Thr Cys Gly Glu Ile Cys Xaa' Ala Tyr Ala Ala Xaa' Cys Thr Gly Cys Xaa' | (SEQ ID NO: 4092) |
| Pro Gly Thr Cys Gly Glu Ile Cys Xaa' Ala Tyr Ala Ala Cys Xaa' Xaa' Thr Gly Cys | (SEQ ID NO: 4093) |
| Pro Gly Thr Cys Gly Glu Ile Cys Xaa' Ala Tyr Ala Ala Cys Xaa' Thr Xaa' Gly Cys | (SEQ ID NO: 4094) |
| Pro Gly Thr Cys Gly Glu Ile Cys Xaa' Ala Tyr Ala Ala Cys Xaa' Thr Gly Xaa' Cys | (SEQ ID NO: 4095) |
| Pro Gly Thr Cys Gly Glu Ile Cys Xaa' Ala Tyr Ala Ala Cys Xaa' Thr Gly Cys Xaa' | (SEQ ID NO: 4096) |
| Pro Gly Thr Cys Gly Glu Ile Cys Xaa' Ala Tyr Ala Ala Cys Thr Xaa' Gly Cys | (SEQ ID NO: 4097) |
| Pro Gly Thr Cys Gly Glu Ile Cys Xaa' Ala Tyr Ala Ala Cys Thr Xaa' Xaa' Gly Cys | (SEQ ID NO: 4098) |
| Pro Gly Thr Cys Gly Glu Ile Cys Xaa' Ala Tyr Ala Ala Cys Thr Xaa' Gly Xaa' Cys | (SEQ ID NO: 4099) |
| Pro Gly Thr Cys Gly Glu Ile Cys Xaa' Ala Tyr Ala Ala Cys Thr Xaa' Gly Cys Xaa' | (SEQ ID NO: 4100) |
| Pro Gly Thr Cys Gly Glu Ile Cys Xaa' Ala Tyr Ala Ala Cys Thr Gly Xaa' Cys | (SEQ ID NO: 4101) |
| Pro Gly Thr Cys Gly Glu Ile Cys Xaa' Ala Tyr Ala Ala Cys Thr Gly Xaa' Cys Xaa' | (SEQ ID NO: 4102) |
| Pro Gly Thr Cys Gly Glu Ile Cys Xaa' Ala Tyr Ala Ala Cys Thr Gly Cys Xaa' | (SEQ ID NO: 4103) |
| Pro Gly Thr Cys Gly Glu Ile Cys Xaa' Ala Tyr Ala Ala Cys Thr Gly Cys Xaa' Xaa' | (SEQ ID NO: 4104) |
| Pro Gly Thr Cys Gly Glu Ile Cys Ala Xaa' Tyr Ala Ala Cys Thr Gly Cys | (SEQ ID NO: 4105) |
| Pro Gly Thr Cys Gly Glu Ile Cys Ala Xaa' Tyr Ala Ala Cys Thr Gly Cys | (SEQ ID NO: 4106) |
| Pro Gly Thr Cys Gly Glu Ile Cys Ala Xaa' Xaa' Tyr Ala Ala Cys Thr Gly Cys | (SEQ ID NO: 4107) |
| Pro Gly Thr Cys Gly Glu Ile Cys Ala Xaa' Xaa' Tyr Ala Ala Cys Thr Gly Cys | (SEQ ID NO: 4108) |
| Pro Gly Thr Cys Gly Glu Ile Cys Ala Xaa' Tyr Xaa' Ala Ala Cys Thr Gly Cys | (SEQ ID NO: 4109) |
| Pro Gly Thr Cys Gly Glu Ile Cys Ala Xaa' Tyr Ala Xaa' Ala Cys Thr Gly Cys | (SEQ ID NO: 4110) |
| Pro Gly Thr Cys Gly Glu Ile Cys Ala Xaa' Tyr Ala Ala Xaa' Cys Thr Gly Cys | (SEQ ID NO: 4111) |
| Pro Gly Thr Cys Gly Glu Ile Cys Ala Xaa' Tyr Ala Ala Xaa' Cys Thr Gly Cys | (SEQ ID NO: 4112) |
| Pro Gly Thr Cys Gly Glu Ile Cys Ala Xaa' Tyr Ala Ala Cys Xaa' Thr Gly Cys | (SEQ ID NO: 4113) |
| Pro Gly Thr Cys Gly Glu Ile Cys Ala Xaa' Tyr Ala Ala Cys Thr Xaa' Gly Cys | (SEQ ID NO: 4114) |
| Pro Gly Thr Cys Gly Glu Ile Cys Ala Xaa' Tyr Ala Ala Cys Thr Gly Xaa' Cys | (SEQ ID NO: 4115) |
| Pro Gly Thr Cys Gly Glu Ile Cys Ala Xaa' Tyr Ala Ala Cys Thr Gly Cys | (SEQ ID NO: 4116) |
| Pro Gly Thr Cys Gly Glu Ile Cys Ala Xaa' Tyr Xaa' Ala Ala Cys Thr Gly Cys | (SEQ ID NO: 4117) |
| Pro Gly Thr Cys Gly Glu Ile Cys Ala Xaa' Tyr Xaa' Ala Ala Cys Thr Gly Cys | (SEQ ID NO: 4118) |

FIG. 2

| | | | | | | | | | | | | |
|---|---|---|---|---|---|---|---|---|---|---|---|---|
| Pro Gly Thr Cys Gly Glu Ile Cys Xaa' Ala Xaa' Tyr Xaa' Ala Ala Xaa' Cys Thr Gly Cys | (SEQ ID NO: 4119) |
| Pro Gly Thr Cys Gly Glu Ile Cys Xaa' Ala Xaa' Tyr Xaa' Ala Ala Cys Xaa' Thr Gly Cys | (SEQ ID NO: 4120) |
| Pro Gly Thr Cys Gly Glu Ile Cys Xaa' Ala Xaa' Tyr Xaa' Ala Ala Cys Thr Xaa' Gly Cys | (SEQ ID NO: 4121) |
| Pro Gly Thr Cys Gly Glu Ile Cys Xaa' Ala Xaa' Tyr Xaa' Ala Ala Cys Thr Gly Xaa' Cys | (SEQ ID NO: 4122) |
| Pro Gly Thr Cys Gly Glu Ile Cys Xaa' Ala Xaa' Tyr Xaa' Ala Ala Cys Thr Gly Cys Xaa' | (SEQ ID NO: 4123) |
| Pro Gly Thr Cys Gly Glu Ile Cys Xaa' Ala Xaa' Tyr Ala Xaa' Ala Cys Thr Gly Cys | (SEQ ID NO: 4124) |
| Pro Gly Thr Cys Gly Glu Ile Cys Xaa' Ala Xaa' Tyr Ala Xaa' Ala Cys Xaa' Thr Gly Cys | (SEQ ID NO: 4125) |
| Pro Gly Thr Cys Gly Glu Ile Cys Xaa' Ala Xaa' Tyr Ala Xaa' Ala Cys Thr Xaa' Gly Cys | (SEQ ID NO: 4126) |
| Pro Gly Thr Cys Gly Glu Ile Cys Xaa' Ala Xaa' Tyr Ala Xaa' Ala Cys Thr Gly Xaa' Cys | (SEQ ID NO: 4127) |
| Pro Gly Thr Cys Gly Glu Ile Cys Xaa' Ala Xaa' Tyr Ala Xaa' Ala Cys Thr Gly Cys Xaa' | (SEQ ID NO: 4128) |
| Pro Gly Thr Cys Gly Glu Ile Cys Xaa' Ala Xaa' Tyr Ala Ala Xaa' Cys Thr Gly Cys | (SEQ ID NO: 4129) |
| Pro Gly Thr Cys Gly Glu Ile Cys Xaa' Ala Xaa' Tyr Ala Ala Xaa' Cys Xaa' Thr Gly Cys | (SEQ ID NO: 4130) |
| Pro Gly Thr Cys Gly Glu Ile Cys Xaa' Ala Xaa' Tyr Ala Ala Xaa' Cys Thr Xaa' Gly Cys | (SEQ ID NO: 4131) |
| Pro Gly Thr Cys Gly Glu Ile Cys Xaa' Ala Xaa' Tyr Ala Ala Xaa' Cys Thr Gly Xaa' Cys | (SEQ ID NO: 4132) |
| Pro Gly Thr Cys Gly Glu Ile Cys Xaa' Ala Xaa' Tyr Ala Ala Xaa' Cys Thr Gly Cys Xaa' | (SEQ ID NO: 4133) |
| Pro Gly Thr Cys Gly Glu Ile Cys Xaa' Ala Xaa' Tyr Ala Ala Cys Xaa' Thr Gly Cys | (SEQ ID NO: 4134) |
| Pro Gly Thr Cys Gly Glu Ile Cys Xaa' Ala Xaa' Tyr Ala Ala Cys Xaa' Thr Gly Xaa' Cys | (SEQ ID NO: 4135) |
| Pro Gly Thr Cys Gly Glu Ile Cys Xaa' Ala Xaa' Tyr Ala Ala Cys Xaa' Thr Gly Cys Xaa' | (SEQ ID NO: 4136) |
| Pro Gly Thr Cys Gly Glu Ile Cys Xaa' Ala Xaa' Tyr Ala Ala Cys Thr Xaa' Gly Cys | (SEQ ID NO: 4137) |
| Pro Gly Thr Cys Gly Glu Ile Cys Xaa' Ala Xaa' Tyr Ala Ala Cys Thr Xaa' Gly Xaa' Cys | (SEQ ID NO: 4138) |
| Pro Gly Thr Cys Gly Glu Ile Cys Xaa' Ala Xaa' Tyr Ala Ala Cys Thr Xaa' Gly Cys Xaa' | (SEQ ID NO: 4139) |
| Pro Gly Thr Cys Gly Glu Ile Cys Xaa' Ala Xaa' Tyr Ala Ala Cys Thr Gly Xaa' Cys | (SEQ ID NO: 4140) |
| Pro Gly Thr Cys Gly Glu Ile Cys Xaa' Ala Xaa' Tyr Ala Ala Cys Thr Gly Xaa' Cys Xaa' | (SEQ ID NO: 4141) |
| Pro Gly Thr Cys Gly Glu Ile Cys Xaa' Ala Xaa' Tyr Ala Ala Cys Thr Gly Cys Xaa' | (SEQ ID NO: 4142) |
| Pro Gly Thr Cys Gly Glu Ile Cys Xaa' Ala Tyr Xaa' Ala Ala Xaa' Cys Thr Gly Cys | (SEQ ID NO: 4143) |
| Pro Gly Thr Cys Gly Glu Ile Cys Xaa' Ala Tyr Xaa' Ala Ala Xaa' Cys Xaa' Thr Gly Cys | (SEQ ID NO: 4144) |
| Pro Gly Thr Cys Gly Glu Ile Cys Xaa' Ala Tyr Xaa' Ala Ala Xaa' Cys Thr Xaa' Gly Cys | (SEQ ID NO: 4145) |
| Pro Gly Thr Cys Gly Glu Ile Cys Xaa' Ala Tyr Xaa' Ala Ala Xaa' Cys Thr Gly Xaa' Cys | (SEQ ID NO: 4146) |
| Pro Gly Thr Cys Gly Glu Ile Cys Xaa' Ala Tyr Xaa' Ala Ala Xaa' Cys Thr Gly Cys Xaa' | (SEQ ID NO: 4147) |
| Pro Gly Thr Cys Gly Glu Ile Cys Xaa' Ala Tyr Xaa' Ala Ala Cys Thr Gly Cys Xaa' | (SEQ ID NO: 4148) |
| Pro Gly Thr Cys Gly Glu Ile Cys Xaa' Ala Tyr Xaa' Ala Ala Cys Thr Gly Cys Xaa' | (SEQ ID NO: 4149) |
| Pro Gly Thr Cys Gly Glu Ile Cys Xaa' Ala Tyr Xaa' Ala Ala Cys Thr Gly Cys | (SEQ ID NO: 4150) |
| Pro Gly Thr Cys Gly Glu Ile Cys Xaa' Ala Tyr Xaa' Ala Ala Cys Thr Gly Cys | (SEQ ID NO: 4151) |
| Pro Gly Thr Cys Gly Glu Ile Cys Xaa' Ala Tyr Xaa' Ala Ala Cys Thr Gly Cys | (SEQ ID NO: 4152) |

FIG. 2

| | | | | | | | | | | | | |
|---|---|---|---|---|---|---|---|---|---|---|---|---|
| Pro Gly Thr Cys Gly Glu Ile Cys Xaa' Ala Tyr Xaa' Xaa' Ala Ala Cys Thr Gly Cys | (SEQ ID NO: 4153) |
| Pro Gly Thr Cys Gly Glu Ile Cys Xaa' Ala Tyr Xaa' Xaa' Ala Ala Xaa' Ala Cys Thr Gly Cys | (SEQ ID NO: 4154) |
| Pro Gly Thr Cys Gly Glu Ile Cys Xaa' Ala Tyr Xaa' Xaa' Ala Ala Xaa' Cys Thr Gly Cys | (SEQ ID NO: 4155) |
| Pro Gly Thr Cys Gly Glu Ile Cys Xaa' Ala Tyr Xaa' Xaa' Ala Ala Xaa' Cys Xaa' Thr Gly Cys | (SEQ ID NO: 4156) |
| Pro Gly Thr Cys Gly Glu Ile Cys Xaa' Ala Tyr Xaa' Xaa' Ala Ala Cys Thr Xaa' Gly Cys | (SEQ ID NO: 4157) |
| Pro Gly Thr Cys Gly Glu Ile Cys Xaa' Ala Tyr Xaa' Xaa' Ala Ala Cys Thr Xaa' Gly Xaa' Cys | (SEQ ID NO: 4158) |
| Pro Gly Thr Cys Gly Glu Ile Cys Xaa' Ala Tyr Xaa' Xaa' Ala Xaa' Ala Cys Thr Gly Xaa' Cys | (SEQ ID NO: 4159) |
| Pro Gly Thr Cys Gly Glu Ile Cys Xaa' Ala Tyr Xaa' Xaa' Ala Xaa' Ala Cys Thr Gly Cys Xaa' | (SEQ ID NO: 4160) |
| Pro Gly Thr Cys Gly Glu Ile Cys Xaa' Ala Tyr Xaa' Xaa' Ala Xaa' Ala Cys Thr Gly Cys | (SEQ ID NO: 4161) |
| Pro Gly Thr Cys Gly Glu Ile Cys Xaa' Ala Tyr Xaa' Xaa' Ala Xaa' Ala Xaa' Ala Cys Thr Gly Cys | (SEQ ID NO: 4162) |
| Pro Gly Thr Cys Gly Glu Ile Cys Xaa' Ala Tyr Xaa' Xaa' Ala Xaa' Ala Xaa' Cys Thr Gly Cys | (SEQ ID NO: 4163) |
| Pro Gly Thr Cys Gly Glu Ile Cys Xaa' Ala Tyr Xaa' Xaa' Ala Xaa' Xaa' Cys Thr Gly Cys | (SEQ ID NO: 4164) |
| Pro Gly Thr Cys Gly Glu Ile Cys Xaa' Ala Tyr Xaa' Xaa' Ala Xaa' Ala Cys Thr Gly Xaa' Cys | (SEQ ID NO: 4165) |
| Pro Gly Thr Cys Gly Glu Ile Cys Xaa' Ala Tyr Xaa' Xaa' Ala Xaa' Ala Cys Thr Gly Cys Xaa' | (SEQ ID NO: 4166) |
| Pro Gly Thr Cys Gly Glu Ile Cys Xaa' Ala Tyr Xaa' Xaa' Xaa' Ala Cys Thr Gly Cys | (SEQ ID NO: 4167) |
| Pro Gly Thr Cys Gly Glu Ile Cys Xaa' Ala Tyr Xaa' Xaa' Xaa' Ala Xaa' Ala Cys Thr Gly Cys | (SEQ ID NO: 4168) |
| Pro Gly Thr Cys Gly Glu Ile Cys Xaa' Ala Tyr Xaa' Xaa' Xaa' Ala Xaa' Cys Thr Gly Cys | (SEQ ID NO: 4169) |
| Pro Gly Thr Cys Gly Glu Ile Cys Xaa' Ala Tyr Xaa' Xaa' Xaa' Ala Cys Xaa' Thr Gly Cys | (SEQ ID NO: 4170) |
| Pro Gly Thr Cys Gly Glu Ile Cys Xaa' Ala Tyr Xaa' Xaa' Xaa' Ala Cys Thr Xaa' Gly Cys | (SEQ ID NO: 4171) |
| Pro Gly Thr Cys Gly Glu Ile Cys Xaa' Ala Tyr Xaa' Xaa' Xaa' Ala Cys Thr Gly Xaa' Cys | (SEQ ID NO: 4172) |
| Pro Gly Thr Cys Gly Glu Ile Cys Xaa' Ala Tyr Xaa' Xaa' Xaa' Ala Cys Thr Gly Cys Xaa' | (SEQ ID NO: 4173) |
| Pro Gly Thr Cys Gly Glu Ile Cys Xaa' Ala Tyr Xaa' Xaa' Ala Ala Cys Xaa' Xaa' Thr Gly Cys | (SEQ ID NO: 4174) |
| Pro Gly Thr Cys Gly Glu Ile Cys Xaa' Ala Tyr Xaa' Xaa' Ala Ala Cys Xaa' Thr Xaa' Gly Cys | (SEQ ID NO: 4175) |
| Pro Gly Thr Cys Gly Glu Ile Cys Xaa' Ala Tyr Xaa' Xaa' Ala Ala Cys Xaa' Thr Gly Xaa' Cys | (SEQ ID NO: 4176) |
| Pro Gly Thr Cys Gly Glu Ile Cys Xaa' Ala Tyr Xaa' Xaa' Ala Ala Cys Xaa' Thr Gly Cys Xaa' | (SEQ ID NO: 4177) |
| Pro Gly Thr Cys Gly Glu Ile Cys Xaa' Ala Tyr Xaa' Xaa' Ala Ala Cys Thr Xaa' Gly Cys | (SEQ ID NO: 4178) |
| Pro Gly Thr Cys Gly Glu Ile Cys Xaa' Ala Tyr Xaa' Xaa' Ala Ala Cys Thr Xaa' Xaa' Gly Cys | (SEQ ID NO: 4179) |
| Pro Gly Thr Cys Gly Glu Ile Cys Xaa' Ala Tyr Xaa' Xaa' Ala Ala Cys Thr Xaa' Gly Xaa' Cys | (SEQ ID NO: 4180) |
| Pro Gly Thr Cys Gly Glu Ile Cys Xaa' Ala Tyr Xaa' Xaa' Ala Ala Cys Thr Xaa' Gly Cys Xaa' | (SEQ ID NO: 4181) |
| Pro Gly Thr Cys Gly Glu Ile Cys Xaa' Ala Tyr Xaa' Xaa' Ala Ala Cys Thr Gly Xaa' Cys | (SEQ ID NO: 4182) |
| Pro Gly Thr Cys Gly Glu Ile Cys Xaa' Ala Tyr Xaa' Xaa' Ala Ala Cys Thr Gly Xaa' Xaa' Cys | (SEQ ID NO: 4183) |
| Pro Gly Thr Cys Gly Glu Ile Cys Xaa' Ala Tyr Xaa' Xaa' Ala Ala Cys Thr Gly Xaa' Cys Xaa' | (SEQ ID NO: 4184) |
| Pro Gly Thr Cys Gly Glu Ile Cys Xaa' Ala Tyr Xaa' Ala Ala Cys Thr Gly Cys Xaa' | (SEQ ID NO: 4185) |
| Pro Gly Thr Cys Gly Glu Ile Cys Xaa' Ala Tyr Xaa' Ala Ala Cys Thr Gly Cys Xaa' Xaa' | (SEQ ID NO: 4186) |

FIG. 2

| | |
|---|---|
| Pro Gly Thr Cys Gly Glu Ile Cys Xaa' Ala Tyr Ala Xaa' Ala Cys Thr Gly Cys | (SEQID NO: 4187) |
| Pro Gly Thr Cys Gly Glu Ile Cys Xaa' Ala Tyr Ala Xaa' Xaa' Ala Cys Thr Gly Cys | (SEQID NO: 4188) |
| Pro Gly Thr Cys Gly Glu Ile Cys Xaa' Ala Tyr Ala Xaa' Xaa' Xaa' Ala Cys Thr Gly Cys | (SEQID NO: 4189) |
| Pro Gly Thr Cys Gly Glu Ile Cys Xaa' Ala Tyr Ala Xaa' Xaa' Xaa' Xaa' Ala Cys Thr Gly Cys | (SEQID NO: 4190) |
| Pro Gly Thr Cys Gly Glu Ile Cys Xaa' Ala Tyr Ala Xaa' Xaa' Xaa' Xaa' Ala Cys Xaa' Thr Gly Cys | (SEQID NO: 4191) |
| Pro Gly Thr Cys Gly Glu Ile Cys Xaa' Ala Tyr Ala Xaa' Xaa' Xaa' Xaa' Ala Cys Xaa' Thr Gly Xaa' Cys | (SEQID NO: 4192) |
| Pro Gly Thr Cys Gly Glu Ile Cys Xaa' Ala Tyr Ala Xaa' Xaa' Xaa' Xaa' Ala Cys Xaa' Thr Gly Xaa' Cys | (SEQID NO: 4193) |
| Pro Gly Thr Cys Gly Glu Ile Cys Xaa' Ala Tyr Ala Xaa' Xaa' Xaa' Xaa' Ala Cys Xaa' Thr Gly Cys Xaa' | (SEQID NO: 4194) |
| Pro Gly Thr Cys Gly Glu Ile Cys Xaa' Ala Tyr Ala Xaa' Xaa' Xaa' Ala Xaa' Cys Thr Gly Cys | (SEQID NO: 4195) |
| Pro Gly Thr Cys Gly Glu Ile Cys Xaa' Ala Tyr Ala Xaa' Xaa' Xaa' Ala Xaa' Cys Xaa' Thr Gly Cys | (SEQID NO: 4196) |
| Pro Gly Thr Cys Gly Glu Ile Cys Xaa' Ala Tyr Ala Xaa' Xaa' Xaa' Ala Xaa' Cys Xaa' Thr Gly Xaa' Cys | (SEQID NO: 4197) |
| Pro Gly Thr Cys Gly Glu Ile Cys Xaa' Ala Tyr Ala Xaa' Xaa' Xaa' Ala Xaa' Cys Xaa' Thr Gly Xaa' Cys | (SEQID NO: 4198) |
| Pro Gly Thr Cys Gly Glu Ile Cys Xaa' Ala Tyr Ala Xaa' Xaa' Xaa' Ala Xaa' Cys Xaa' Thr Gly Cys Xaa' | (SEQID NO: 4199) |
| Pro Gly Thr Cys Gly Glu Ile Cys Xaa' Ala Tyr Ala Xaa' Xaa' Ala Xaa' Xaa' Cys Thr Gly Cys | (SEQID NO: 4200) |
| Pro Gly Thr Cys Gly Glu Ile Cys Xaa' Ala Tyr Ala Xaa' Xaa' Ala Xaa' Xaa' Cys Xaa' Thr Gly Cys | (SEQID NO: 4201) |
| Pro Gly Thr Cys Gly Glu Ile Cys Xaa' Ala Tyr Ala Xaa' Xaa' Ala Xaa' Xaa' Cys Xaa' Thr Gly Xaa' Cys | (SEQID NO: 4202) |
| Pro Gly Thr Cys Gly Glu Ile Cys Xaa' Ala Tyr Ala Xaa' Xaa' Ala Xaa' Xaa' Cys Xaa' Thr Gly Xaa' Cys | (SEQID NO: 4203) |
| Pro Gly Thr Cys Gly Glu Ile Cys Xaa' Ala Tyr Ala Xaa' Xaa' Ala Xaa' Xaa' Cys Xaa' Thr Gly Cys Xaa' | (SEQID NO: 4204) |
| Pro Gly Thr Cys Gly Glu Ile Cys Xaa' Ala Tyr Ala Xaa' Ala Xaa' Xaa' Xaa' Cys Thr Gly Cys | (SEQID NO: 4205) |
| Pro Gly Thr Cys Gly Glu Ile Cys Xaa' Ala Tyr Ala Xaa' Ala Xaa' Xaa' Xaa' Cys Xaa' Thr Gly Cys | (SEQID NO: 4206) |
| Pro Gly Thr Cys Gly Glu Ile Cys Xaa' Ala Tyr Ala Xaa' Ala Xaa' Xaa' Xaa' Cys Xaa' Thr Gly Xaa' Cys | (SEQID NO: 4207) |
| Pro Gly Thr Cys Gly Glu Ile Cys Xaa' Ala Tyr Ala Xaa' Ala Xaa' Xaa' Xaa' Cys Xaa' Thr Gly Xaa' Cys | (SEQID NO: 4208) |
| Pro Gly Thr Cys Gly Glu Ile Cys Xaa' Ala Tyr Ala Xaa' Ala Xaa' Xaa' Xaa' Cys Xaa' Thr Gly Cys Xaa' | (SEQID NO: 4209) |
| Pro Gly Thr Cys Gly Glu Ile Cys Xaa' Ala Tyr Ala Ala Xaa' Xaa' Xaa' Xaa' Cys Thr Gly Cys | (SEQID NO: 4210) |
| Pro Gly Thr Cys Gly Glu Ile Cys Xaa' Ala Tyr Ala Ala Xaa' Xaa' Xaa' Xaa' Cys Xaa' Thr Gly Cys | (SEQID NO: 4211) |
| Pro Gly Thr Cys Gly Glu Ile Cys Xaa' Ala Tyr Ala Ala Xaa' Xaa' Xaa' Xaa' Cys Xaa' Thr Gly Xaa' Cys | (SEQID NO: 4212) |
| Pro Gly Thr Cys Gly Glu Ile Cys Xaa' Ala Tyr Ala Ala Xaa' Xaa' Xaa' Xaa' Cys Xaa' Thr Gly Xaa' Cys | (SEQID NO: 4213) |
| Pro Gly Thr Cys Gly Glu Ile Cys Xaa' Ala Tyr Ala Ala Xaa' Xaa' Xaa' Xaa' Cys Xaa' Thr Gly Cys Xaa' | (SEQID NO: 4214) |
| Pro Gly Thr Cys Gly Glu Ile Cys Xaa' Ala Tyr Ala Ala Ala Xaa' Xaa' Xaa' Cys Thr Gly Cys | (SEQID NO: 4215) |
| Pro Gly Thr Cys Gly Glu Ile Cys Xaa' Ala Tyr Ala Ala Ala Xaa' Xaa' Xaa' Cys Xaa' Thr Gly Cys | (SEQID NO: 4216) |
| Pro Gly Thr Cys Gly Glu Ile Cys Xaa' Ala Tyr Ala Ala Ala Xaa' Xaa' Xaa' Cys Xaa' Thr Gly Xaa' Cys | (SEQID NO: 4217) |
| Pro Gly Thr Cys Gly Glu Ile Cys Xaa' Ala Tyr Ala Ala Ala Xaa' Xaa' Xaa' Cys Xaa' Thr Gly Xaa' Cys | (SEQID NO: 4218) |
| Pro Gly Thr Cys Gly Glu Ile Cys Xaa' Ala Tyr Ala Ala Ala Xaa' Xaa' Xaa' Cys Xaa' Thr Gly Cys Xaa' | (SEQID NO: 4219) |
| Pro Gly Thr Cys Gly Glu Ile Cys Xaa' Ala Tyr Ala Ala Ala Ala Xaa' Xaa' Cys Thr Gly Xaa' Cys | (SEQID NO: 4220) |

FIG. 2

```
Pro Gly Thr Cys Gly Glu Ile Cys Xaa' Ala Tyr Ala Ala Xaa' Cys Thr Gly Cys Xaa'    (SEQ ID NO: 4221)
Pro Gly Thr Cys Gly Glu Ile Cys Xaa' Ala Tyr Ala Ala Xaa' Cys Xaa' Thr Gly Cys     (SEQ ID NO: 4222)
Pro Gly Thr Cys Gly Glu Ile Cys Xaa' Ala Tyr Ala Ala Xaa' Cys Xaa' Xaa' Thr Gly Cys (SEQ ID NO: 4223)
Pro Gly Thr Cys Gly Glu Ile Cys Xaa' Ala Tyr Ala Ala Xaa' Cys Xaa' Thr Xaa' Gly Cys (SEQ ID NO: 4224)
Pro Gly Thr Cys Gly Glu Ile Cys Xaa' Ala Tyr Ala Ala Xaa' Cys Xaa' Thr Gly Xaa' Cys (SEQ ID NO: 4225)
Pro Gly Thr Cys Gly Glu Ile Cys Xaa' Ala Tyr Ala Ala Xaa' Cys Xaa' Thr Gly Cys Xaa' (SEQ ID NO: 4226)
Pro Gly Thr Cys Gly Glu Ile Cys Xaa' Ala Tyr Ala Ala Xaa' Cys Thr Xaa' Gly Cys     (SEQ ID NO: 4227)
Pro Gly Thr Cys Gly Glu Ile Cys Xaa' Ala Tyr Ala Ala Xaa' Cys Thr Xaa' Xaa' Gly Cys (SEQ ID NO: 4228)
Pro Gly Thr Cys Gly Glu Ile Cys Xaa' Ala Tyr Ala Ala Xaa' Cys Thr Xaa' Gly Xaa' Cys (SEQ ID NO: 4229)
Pro Gly Thr Cys Gly Glu Ile Cys Xaa' Ala Tyr Ala Ala Xaa' Cys Thr Xaa' Gly Cys Xaa' (SEQ ID NO: 4230)
Pro Gly Thr Cys Gly Glu Ile Cys Xaa' Ala Tyr Ala Ala Xaa' Cys Thr Gly Xaa' Cys     (SEQ ID NO: 4231)
Pro Gly Thr Cys Gly Glu Ile Cys Xaa' Ala Tyr Ala Ala Xaa' Cys Thr Gly Xaa' Xaa' Cys (SEQ ID NO: 4232)
Pro Gly Thr Cys Gly Glu Ile Cys Xaa' Ala Tyr Ala Ala Xaa' Cys Thr Gly Xaa' Cys Xaa' (SEQ ID NO: 4233)
Pro Gly Thr Cys Gly Glu Ile Cys Xaa' Ala Tyr Ala Ala Xaa' Cys Thr Gly Cys Xaa'    (SEQ ID NO: 4234)
Pro Gly Thr Cys Gly Glu Ile Cys Xaa' Ala Tyr Ala Ala Xaa' Cys Thr Gly Cys Xaa' Xaa' (SEQ ID NO: 4235)
Pro Gly Thr Cys Gly Glu Ile Cys Xaa' Ala Tyr Ala Ala Cys Xaa' Xaa' Thr Gly Cys     (SEQ ID NO: 4236)
Pro Gly Thr Cys Gly Glu Ile Cys Xaa' Ala Tyr Ala Ala Cys Xaa' Xaa' Xaa' Thr Gly Cys (SEQ ID NO: 4237)
Pro Gly Thr Cys Gly Glu Ile Cys Xaa' Ala Tyr Ala Ala Cys Xaa' Xaa' Thr Xaa' Gly Cys (SEQ ID NO: 4238)
Pro Gly Thr Cys Gly Glu Ile Cys Xaa' Ala Tyr Ala Ala Cys Xaa' Xaa' Thr Gly Xaa' Cys (SEQ ID NO: 4239)
Pro Gly Thr Cys Gly Glu Ile Cys Xaa' Ala Tyr Ala Ala Cys Xaa' Xaa' Thr Gly Cys Xaa' (SEQ ID NO: 4240)
Pro Gly Thr Cys Gly Glu Ile Cys Xaa' Ala Tyr Ala Ala Cys Xaa' Thr Xaa' Gly Cys     (SEQ ID NO: 4241)
Pro Gly Thr Cys Gly Glu Ile Cys Xaa' Ala Tyr Ala Ala Cys Xaa' Thr Xaa' Xaa' Gly Cys (SEQ ID NO: 4242)
Pro Gly Thr Cys Gly Glu Ile Cys Xaa' Ala Tyr Ala Ala Cys Xaa' Thr Xaa' Gly Xaa' Cys (SEQ ID NO: 4243)
Pro Gly Thr Cys Gly Glu Ile Cys Xaa' Ala Tyr Ala Ala Cys Xaa' Thr Xaa' Gly Cys Xaa' (SEQ ID NO: 4244)
Pro Gly Thr Cys Gly Glu Ile Cys Xaa' Ala Tyr Ala Ala Cys Xaa' Thr Gly Xaa' Cys     (SEQ ID NO: 4245)
Pro Gly Thr Cys Gly Glu Ile Cys Xaa' Ala Tyr Ala Ala Cys Xaa' Thr Gly Xaa' Xaa' Cys (SEQ ID NO: 4246)
Pro Gly Thr Cys Gly Glu Ile Cys Xaa' Ala Tyr Ala Ala Cys Xaa' Thr Gly Xaa' Cys Xaa' (SEQ ID NO: 4247)
Pro Gly Thr Cys Gly Glu Ile Cys Xaa' Ala Tyr Ala Ala Cys Xaa' Thr Gly Cys Xaa'    (SEQ ID NO: 4248)
Pro Gly Thr Cys Gly Glu Ile Cys Xaa' Ala Tyr Ala Ala Cys Xaa' Thr Gly Cys Xaa' Xaa' (SEQ ID NO: 4249)
Pro Gly Thr Cys Gly Glu Ile Cys Xaa' Ala Tyr Ala Ala Cys Thr Xaa' Xaa' Gly Cys     (SEQ ID NO: 4250)
Pro Gly Thr Cys Gly Glu Ile Cys Xaa' Ala Tyr Ala Ala Cys Thr Xaa' Xaa' Xaa' Gly Cys (SEQ ID NO: 4251)
Pro Gly Thr Cys Gly Glu Ile Cys Xaa' Ala Tyr Ala Ala Cys Thr Xaa' Xaa' Gly Xaa' Cys (SEQ ID NO: 4252)
Pro Gly Thr Cys Gly Glu Ile Cys Xaa' Ala Tyr Ala Ala Cys Thr Xaa' Xaa' Gly Cys Xaa' (SEQ ID NO: 4253)
Pro Gly Thr Cys Gly Glu Ile Cys Xaa' Ala Tyr Ala Ala Cys Thr Xaa' Xaa' Xaa' Gly Cys (SEQ ID NO: 4254)
```

FIG. 2

```
Pro Gly Thr Cys Gly Glu Ile Cys Xaa' Ala Tyr Ala Ala Cys Thr Xaa' Xaa' Gly Cys Xaa'   (SEQ ID NO: 4255)
Pro Gly Thr Cys Gly Glu Ile Cys Xaa' Ala Tyr Ala Ala Cys Thr Xaa' Gly Xaa' Xaa' Cys    (SEQ ID NO: 4256)
Pro Gly Thr Cys Gly Glu Ile Cys Xaa' Ala Tyr Ala Ala Cys Thr Xaa' Gly Xaa' Xaa' Cys    (SEQ ID NO: 4257)
Pro Gly Thr Cys Gly Glu Ile Cys Xaa' Ala Tyr Ala Ala Cys Thr Xaa' Gly Xaa' Cys Xaa'    (SEQ ID NO: 4258)
Pro Gly Thr Cys Gly Glu Ile Cys Xaa' Ala Tyr Ala Ala Cys Thr Xaa' Gly Xaa' Cys Xaa'    (SEQ ID NO: 4259)
Pro Gly Thr Cys Gly Glu Ile Cys Xaa' Ala Tyr Ala Ala Cys Thr Xaa' Gly Cys Xaa' Xaa'    (SEQ ID NO: 4260)
Pro Gly Thr Cys Gly Glu Ile Cys Xaa' Ala Tyr Ala Ala Cys Thr Xaa' Gly Cys Xaa' Xaa'    (SEQ ID NO: 4261)
Pro Gly Thr Cys Gly Glu Ile Cys Xaa' Ala Tyr Ala Ala Cys Thr Gly Xaa' Xaa' Xaa' Cys    (SEQ ID NO: 4262)
Pro Gly Thr Cys Gly Glu Ile Cys Xaa' Ala Tyr Ala Ala Cys Thr Gly Xaa' Xaa' Xaa' Cys    (SEQ ID NO: 4263)
Pro Gly Thr Cys Gly Glu Ile Cys Xaa' Ala Tyr Ala Ala Cys Thr Gly Xaa' Xaa' Cys Xaa'    (SEQ ID NO: 4264)
Pro Gly Thr Cys Gly Glu Ile Cys Xaa' Ala Tyr Ala Ala Cys Thr Gly Xaa' Xaa' Cys Xaa'    (SEQ ID NO: 4265)
Pro Gly Thr Cys Gly Glu Ile Cys Xaa' Ala Tyr Ala Ala Cys Thr Gly Xaa' Cys Xaa' Xaa'    (SEQ ID NO: 4266)
Pro Gly Thr Cys Gly Glu Ile Cys Xaa' Ala Tyr Ala Ala Cys Thr Gly Xaa' Cys Xaa' Xaa'    (SEQ ID NO: 4267)
Pro Gly Thr Cys Gly Glu Ile Cys Xaa' Ala Tyr Ala Ala Cys Thr Gly Cys Xaa' Xaa' Xaa'    (SEQ ID NO: 4268)
Pro Gly Thr Cys Gly Glu Ile Cys Xaa' Ala Tyr Ala Ala Cys Thr Gly Cys Xaa' Xaa' Xaa'    (SEQ ID NO: 4269)
Pro Gly Thr Cys Gly Glu Ile Cys Ala Xaa' Tyr Ala Ala Cys Thr Gly Cys                   (SEQ ID NO: 4270)
Pro Gly Thr Cys Gly Glu Ile Cys Ala Xaa' Tyr Ala Ala Cys Thr Gly Cys                   (SEQ ID NO: 4271)
Pro Gly Thr Cys Gly Glu Ile Cys Ala Xaa' Xaa' Xaa' Xaa' Tyr Ala Ala Cys Thr Gly Cys    (SEQ ID NO: 4272)
Pro Gly Thr Cys Gly Glu Ile Cys Ala Xaa' Xaa' Xaa' Xaa' Tyr Ala Ala Cys Thr Gly Cys    (SEQ ID NO: 4273)
Pro Gly Thr Cys Gly Glu Ile Cys Ala Xaa' Xaa' Xaa' Xaa' Tyr Xaa' Ala Ala Cys Thr Gly Cys  (SEQ ID NO: 4274)
Pro Gly Thr Cys Gly Glu Ile Cys Ala Xaa' Xaa' Xaa' Xaa' Tyr Ala Xaa' Ala Cys Thr Gly Cys  (SEQ ID NO: 4275)
Pro Gly Thr Cys Gly Glu Ile Cys Ala Xaa' Xaa' Xaa' Xaa' Tyr Ala Ala Xaa' Cys Thr Gly Cys  (SEQ ID NO: 4276)
Pro Gly Thr Cys Gly Glu Ile Cys Ala Xaa' Xaa' Xaa' Xaa' Tyr Ala Ala Ala Cys Thr Gly Cys   (SEQ ID NO: 4277)
Pro Gly Thr Cys Gly Glu Ile Cys Ala Xaa' Xaa' Xaa' Xaa' Tyr Ala Ala Ala Cys Thr Xaa' Gly Cys  (SEQ ID NO: 4278)
Pro Gly Thr Cys Gly Glu Ile Cys Ala Xaa' Xaa' Xaa' Xaa' Tyr Ala Ala Ala Cys Thr Gly Xaa' Cys  (SEQ ID NO: 4279)
Pro Gly Thr Cys Gly Glu Ile Cys Ala Xaa' Xaa' Xaa' Xaa' Tyr Ala Ala Ala Cys Thr Gly Cys Xaa'  (SEQ ID NO: 4280)
Pro Gly Thr Cys Gly Glu Ile Cys Ala Xaa' Xaa' Xaa' Xaa' Tyr Xaa' Ala Ala Cys Thr Gly Cys      (SEQ ID NO: 4281)
Pro Gly Thr Cys Gly Glu Ile Cys Ala Xaa' Xaa' Xaa' Xaa' Tyr Ala Xaa' Ala Cys Thr Gly Cys      (SEQ ID NO: 4282)
Pro Gly Thr Cys Gly Glu Ile Cys Ala Xaa' Xaa' Xaa' Xaa' Tyr Ala Ala Xaa' Cys Thr Gly Cys      (SEQ ID NO: 4283)
Pro Gly Thr Cys Gly Glu Ile Cys Ala Xaa' Xaa' Xaa' Xaa' Tyr Ala Ala Ala Cys Thr Gly Cys       (SEQ ID NO: 4284)
Pro Gly Thr Cys Gly Glu Ile Cys Ala Xaa' Xaa' Xaa' Xaa' Tyr Ala Ala Ala Cys Thr Xaa' Gly Cys  (SEQ ID NO: 4285)
Pro Gly Thr Cys Gly Glu Ile Cys Ala Xaa' Xaa' Xaa' Xaa' Tyr Ala Ala Ala Cys Thr Gly Xaa' Cys  (SEQ ID NO: 4286)
Pro Gly Thr Cys Gly Glu Ile Cys Ala Xaa' Ala Xaa' Tyr Xaa' Ala Ala Cys Thr Gly Xaa' Cys       (SEQ ID NO: 4287)
Pro Gly Thr Cys Gly Glu Ile Cys Ala Xaa' Xaa' Xaa' Tyr Ala Ala Ala Cys Thr Gly Cys Xaa'       (SEQ ID NO: 4288)
```

FIG. 2

| | | | | | | | | | | |
|---|---|---|---|---|---|---|---|---|---|---|
| Pro Gly Thr Cys Gly Glu Ile Cys Ala Xaa' Tyr Ala Xaa' Ala Cys Thr Gly Cys | (SEQID NO: 4289) |
| Pro Gly Thr Cys Gly Glu Ile Cys Ala Xaa' Tyr Ala Xaa' Xaa' Ala Cys Thr Gly Cys | (SEQID NO: 4290) |
| Pro Gly Thr Cys Gly Glu Ile Cys Ala Xaa' Tyr Ala Xaa' Ala Xaa' Cys Thr Gly Cys | (SEQID NO: 4291) |
| Pro Gly Thr Cys Gly Glu Ile Cys Ala Xaa' Tyr Ala Xaa' Ala Cys Xaa' Thr Gly Cys | (SEQID NO: 4292) |
| Pro Gly Thr Cys Gly Glu Ile Cys Ala Xaa' Tyr Ala Xaa' Ala Cys Thr Xaa' Gly Cys | (SEQID NO: 4293) |
| Pro Gly Thr Cys Gly Glu Ile Cys Ala Xaa' Tyr Ala Xaa' Ala Cys Thr Gly Xaa' Cys | (SEQID NO: 4294) |
| Pro Gly Thr Cys Gly Glu Ile Cys Ala Xaa' Tyr Ala Xaa' Ala Cys Thr Gly Cys Xaa' | (SEQID NO: 4295) |
| Pro Gly Thr Cys Gly Glu Ile Cys Ala Xaa' Tyr Ala Ala Xaa' Cys Thr Gly Cys | (SEQID NO: 4296) |
| Pro Gly Thr Cys Gly Glu Ile Cys Ala Xaa' Tyr Ala Ala Xaa' Xaa' Cys Thr Gly Cys | (SEQID NO: 4297) |
| Pro Gly Thr Cys Gly Glu Ile Cys Ala Xaa' Tyr Ala Ala Xaa' Cys Xaa' Thr Gly Cys | (SEQID NO: 4298) |
| Pro Gly Thr Cys Gly Glu Ile Cys Ala Xaa' Tyr Ala Ala Xaa' Cys Thr Xaa' Gly Cys | (SEQID NO: 4299) |
| Pro Gly Thr Cys Gly Glu Ile Cys Ala Xaa' Tyr Ala Ala Xaa' Cys Thr Gly Xaa' Cys | (SEQID NO: 4300) |
| Pro Gly Thr Cys Gly Glu Ile Cys Ala Xaa' Tyr Ala Ala Xaa' Cys Thr Gly Cys Xaa' | (SEQID NO: 4301) |
| Pro Gly Thr Cys Gly Glu Ile Cys Ala Xaa' Tyr Ala Ala Ala Cys Xaa' Thr Gly Cys | (SEQID NO: 4302) |
| Pro Gly Thr Cys Gly Glu Ile Cys Ala Xaa' Tyr Ala Ala Ala Cys Xaa' Xaa' Thr Gly Cys | (SEQID NO: 4303) |
| Pro Gly Thr Cys Gly Glu Ile Cys Ala Xaa' Tyr Ala Ala Ala Cys Xaa' Thr Xaa' Gly Cys | (SEQID NO: 4304) |
| Pro Gly Thr Cys Gly Glu Ile Cys Ala Xaa' Tyr Ala Ala Ala Cys Xaa' Thr Gly Xaa' Cys | (SEQID NO: 4305) |
| Pro Gly Thr Cys Gly Glu Ile Cys Ala Xaa' Tyr Ala Ala Ala Cys Xaa' Thr Gly Cys Xaa' | (SEQID NO: 4306) |
| Pro Gly Thr Cys Gly Glu Ile Cys Ala Xaa' Tyr Ala Ala Ala Cys Thr Xaa' Gly Cys | (SEQID NO: 4307) |
| Pro Gly Thr Cys Gly Glu Ile Cys Ala Xaa' Tyr Ala Ala Ala Cys Thr Xaa' Xaa' Gly Cys | (SEQID NO: 4308) |
| Pro Gly Thr Cys Gly Glu Ile Cys Ala Xaa' Tyr Ala Ala Ala Cys Thr Xaa' Gly Xaa' Cys | (SEQID NO: 4309) |
| Pro Gly Thr Cys Gly Glu Ile Cys Ala Xaa' Tyr Ala Ala Ala Cys Thr Xaa' Gly Cys Xaa' | (SEQID NO: 4310) |
| Pro Gly Thr Cys Gly Glu Ile Cys Ala Xaa' Tyr Ala Ala Ala Cys Thr Gly Xaa' Cys | (SEQID NO: 4311) |
| Pro Gly Thr Cys Gly Glu Ile Cys Ala Xaa' Tyr Xaa' Ala Ala Ala Cys Thr Gly Xaa' Xaa' Cys | (SEQID NO: 4312) |
| Pro Gly Thr Cys Gly Glu Ile Cys Ala Xaa' Tyr Xaa' Ala Ala Ala Cys Thr Gly Xaa' Cys Xaa' | (SEQID NO: 4313) |
| Pro Gly Thr Cys Gly Glu Ile Cys Ala Xaa' Tyr Xaa' Ala Ala Ala Cys Thr Gly Cys Xaa' | (SEQID NO: 4314) |
| Pro Gly Thr Cys Gly Glu Ile Cys Ala Xaa' Tyr Xaa' Ala Ala Ala Cys Thr Gly Cys Xaa' Xaa' | (SEQID NO: 4315) |
| Pro Gly Thr Cys Gly Glu Ile Cys Ala Xaa' Tyr Xaa' Ala Ala Ala Cys Thr Gly Cys | (SEQID NO: 4316) |
| Pro Gly Thr Cys Gly Glu Ile Cys Ala Tyr Xaa' Ala Ala Ala Cys Thr Gly Cys | (SEQID NO: 4317) |
| Pro Gly Thr Cys Gly Glu Ile Cys Ala Xaa' Tyr Xaa' Ala Ala Ala Cys Ala Cys Thr Gly Cys | (SEQID NO: 4318) |
| Pro Gly Thr Cys Gly Glu Ile Cys Ala Xaa' Tyr Xaa' Ala Ala Xaa' Ala Cys Thr Gly Cys | (SEQID NO: 4319) |
| Pro Gly Thr Cys Gly Glu Ile Cys Ala Xaa' Tyr Xaa' Ala Xaa' Ala Cys Thr Gly Cys | (SEQID NO: 4320) |
| Pro Gly Thr Cys Gly Glu Ile Cys Ala Xaa' Tyr Xaa' Xaa' Ala Ala Cys Thr Gly Cys | (SEQID NO: 4321) |
| Pro Gly Thr Cys Gly Glu Ile Cys Ala Xaa' Tyr Xaa' Ala Ala Ala Cys Thr Xaa' Gly Cys | (SEQID NO: 4322) |

FIG. 2

| | | | | | | | | | | | |
|---|---|---|---|---|---|---|---|---|---|---|---|
| Pro Gly Thr Cys Gly Glu Ile Cys Ala Xaa' Tyr Xaa' Ala Ala Cys Thr Gly Xaa' Cys | (SEQ ID NO: 4323) |
| Pro Gly Thr Cys Gly Glu Ile Cys Ala Xaa' Tyr Xaa' Xaa' Ala Ala Cys Thr Gly Cys Xaa' | (SEQ ID NO: 4324) |
| Pro Gly Thr Cys Gly Glu Ile Cys Ala Xaa' Tyr Xaa' Xaa' Ala Xaa' Ala Cys Thr Gly Cys | (SEQ ID NO: 4325) |
| Pro Gly Thr Cys Gly Glu Ile Cys Ala Xaa' Tyr Xaa' Xaa' Ala Xaa' Cys Thr Gly Gly Cys | (SEQ ID NO: 4326) |
| Pro Gly Thr Cys Gly Glu Ile Cys Ala Xaa' Tyr Xaa' Xaa' Ala Xaa' Cys Xaa' Ala Gly Cys | (SEQ ID NO: 4327) |
| Pro Gly Thr Cys Gly Glu Ile Cys Ala Xaa' Tyr Xaa' Xaa' Ala Xaa' Cys Ala Xaa' Gly Cys | (SEQ ID NO: 4328) |
| Pro Gly Thr Cys Gly Glu Ile Cys Ala Xaa' Tyr Xaa' Xaa' Ala Xaa' Cys Ala Thr Xaa' Cys | (SEQ ID NO: 4329) |
| Pro Gly Thr Cys Gly Glu Ile Cys Ala Xaa' Tyr Xaa' Xaa' Ala Xaa' Cys Ala Thr Gly Xaa' | (SEQ ID NO: 4330) |
| Pro Gly Thr Cys Gly Glu Ile Cys Ala Xaa' Tyr Xaa' Xaa' Ala Xaa' Ala Cys Thr Gly Cys | (SEQ ID NO: 4331) |
| Pro Gly Thr Cys Gly Glu Ile Cys Ala Xaa' Tyr Xaa' Xaa' Ala Ala Xaa' Cys Thr Gly Cys | (SEQ ID NO: 4332) |
| Pro Gly Thr Cys Gly Glu Ile Cys Ala Xaa' Tyr Xaa' Xaa' Ala Ala Cys Xaa' Thr Gly Cys | (SEQ ID NO: 4333) |
| Pro Gly Thr Cys Gly Glu Ile Cys Ala Xaa' Tyr Xaa' Xaa' Ala Ala Cys Thr Xaa' Gly Cys | (SEQ ID NO: 4334) |
| Pro Gly Thr Cys Gly Glu Ile Cys Ala Xaa' Tyr Xaa' Xaa' Ala Ala Cys Thr Gly Xaa' Cys | (SEQ ID NO: 4335) |
| Pro Gly Thr Cys Gly Glu Ile Cys Ala Xaa' Tyr Xaa' Xaa' Ala Ala Cys Thr Gly Cys Xaa' | (SEQ ID NO: 4336) |
| Pro Gly Thr Cys Gly Glu Ile Cys Ala Xaa' Tyr Xaa' Xaa' Xaa' Ala Cys Thr Gly Cys Xaa' | (SEQ ID NO: 4337) |
| Pro Gly Thr Cys Gly Glu Ile Cys Ala Xaa' Tyr Xaa' Xaa' Xaa' Ala Cys Xaa' Thr Gly Cys | (SEQ ID NO: 4338) |
| Pro Gly Thr Cys Gly Glu Ile Cys Ala Xaa' Tyr Xaa' Xaa' Xaa' Cys Thr Xaa' Gly Cys | (SEQ ID NO: 4339) |
| Pro Gly Thr Cys Gly Glu Ile Cys Ala Xaa' Tyr Xaa' Xaa' Xaa' Cys Thr Xaa' Gly Cys | (SEQ ID NO: 4340) |
| Pro Gly Thr Cys Gly Glu Ile Cys Ala Xaa' Tyr Xaa' Xaa' Xaa' Cys Xaa' Thr Gly Cys | (SEQ ID NO: 4341) |
| Pro Gly Thr Cys Gly Glu Ile Cys Ala Xaa' Tyr Xaa' Xaa' Ala Cys Thr Xaa' Gly Cys | (SEQ ID NO: 4342) |
| Pro Gly Thr Cys Gly Glu Ile Cys Ala Xaa' Tyr Xaa' Xaa' Ala Cys Thr Xaa' Gly Cys | (SEQ ID NO: 4343) |
| Pro Gly Thr Cys Gly Glu Ile Cys Ala Xaa' Tyr Xaa' Xaa' Ala Cys Thr Gly Cys | (SEQ ID NO: 4344) |
| Pro Gly Thr Cys Gly Glu Ile Cys Ala Xaa' Tyr Xaa' Xaa' Ala Ala Cys Thr Xaa' Gly Cys | (SEQ ID NO: 4345) |
| Pro Gly Thr Cys Gly Glu Ile Cys Ala Xaa' Tyr Xaa' Xaa' Ala Ala Cys Thr Gly Xaa' Cys | (SEQ ID NO: 4346) |
| Pro Gly Thr Cys Gly Glu Ile Cys Ala Xaa' Tyr Xaa' Xaa' Ala Ala Cys Thr Gly Cys | (SEQ ID NO: 4347) |
| Pro Gly Thr Cys Gly Glu Ile Cys Ala Xaa' Tyr Xaa' Xaa' Ala Ala Cys Thr Gly Xaa' Cys | (SEQ ID NO: 4348) |
| Pro Gly Thr Cys Gly Glu Ile Cys Ala Xaa' Tyr Xaa' Xaa' Ala Ala Cys Thr Gly Cys Xaa' | (SEQ ID NO: 4349) |
| Pro Gly Thr Cys Gly Glu Ile Cys Ala Xaa' Tyr Xaa' Xaa' Ala Ala Cys Thr Gly Xaa' Cys | (SEQ ID NO: 4350) |
| Pro Gly Thr Cys Gly Glu Ile Cys Ala Xaa' Tyr Xaa' Xaa' Ala Ala Cys Thr Gly Cys Xaa' | (SEQ ID NO: 4351) |
| Pro Gly Thr Cys Gly Glu Ile Cys Ala Xaa' Tyr Ala Xaa' Xaa' Ala Cys Thr Gly Cys | (SEQ ID NO: 4352) |
| Pro Gly Thr Cys Gly Glu Ile Cys Ala Xaa' Tyr Ala Xaa' Xaa' Ala Cys Thr Gly Cys | (SEQ ID NO: 4353) |
| Pro Gly Thr Cys Gly Glu Ile Cys Ala Xaa' Tyr Ala Xaa' Xaa' Ala Xaa' Cys Thr Gly Cys | (SEQ ID NO: 4354) |
| Pro Gly Thr Cys Gly Glu Ile Cys Ala Xaa' Tyr Ala Xaa' Xaa' Ala Xaa' Cys Thr Gly Cys | (SEQ ID NO: 4355) |
| Pro Gly Thr Cys Gly Glu Ile Cys Ala Xaa' Tyr Ala Xaa' Xaa' Ala Xaa' Cys Thr Gly Cys | (SEQ ID NO: 4356) |

FIG. 2

Pro Gly Thr Cys Gly Glu Ile Cys Ala Xaa' Tyr Ala Xaa' Xaa' Ala Cys Thr Xaa' Gly Cys (SEQ ID NO: 4357)
Pro Gly Thr Cys Gly Glu Ile Cys Ala Xaa' Tyr Ala Xaa' Xaa' Ala Cys Thr Gly Xaa' Cys (SEQ ID NO: 4358)
Pro Gly Thr Cys Gly Glu Ile Cys Ala Xaa' Tyr Ala Xaa' Xaa' Ala Cys Thr Gly Cys Xaa' (SEQ ID NO: 4359)
Pro Gly Thr Cys Gly Glu Ile Cys Ala Xaa' Tyr Ala Xaa' Xaa' Ala Xaa' Cys Thr Gly Cys (SEQ ID NO: 4360)
Pro Gly Thr Cys Gly Glu Ile Cys Ala Xaa' Tyr Ala Xaa' Xaa' Xaa' Ala Cys Thr Gly Cys (SEQ ID NO: 4361)
Pro Gly Thr Cys Gly Glu Ile Cys Ala Xaa' Tyr Ala Xaa' Xaa' Ala Cys Xaa' Thr Gly Cys (SEQ ID NO: 4362)
Pro Gly Thr Cys Gly Glu Ile Cys Ala Xaa' Tyr Ala Xaa' Ala Xaa' Cys Thr Gly Xaa' Cys (SEQ ID NO: 4363)
Pro Gly Thr Cys Gly Glu Ile Cys Ala Xaa' Tyr Ala Xaa' Ala Xaa' Cys Thr Gly Cys Xaa' (SEQ ID NO: 4364)
Pro Gly Thr Cys Gly Glu Ile Cys Ala Xaa' Tyr Ala Xaa' Ala Xaa' Xaa' Cys Thr Gly Cys (SEQ ID NO: 4365)
Pro Gly Thr Cys Gly Glu Ile Cys Ala Xaa' Tyr Ala Xaa' Ala Xaa' Cys Xaa' Thr Gly Cys (SEQ ID NO: 4366)
Pro Gly Thr Cys Gly Glu Ile Cys Ala Xaa' Tyr Ala Xaa' Ala Cys Xaa' Xaa' Thr Gly Cys (SEQ ID NO: 4367)
Pro Gly Thr Cys Gly Glu Ile Cys Ala Xaa' Tyr Ala Xaa' Ala Cys Xaa' Thr Xaa' Gly Cys (SEQ ID NO: 4368)
Pro Gly Thr Cys Gly Glu Ile Cys Ala Xaa' Tyr Ala Xaa' Ala Cys Xaa' Thr Gly Xaa' Cys (SEQ ID NO: 4369)
Pro Gly Thr Cys Gly Glu Ile Cys Ala Xaa' Tyr Ala Xaa' Ala Cys Xaa' Thr Gly Cys Xaa' (SEQ ID NO: 4370)
Pro Gly Thr Cys Gly Glu Ile Cys Ala Xaa' Tyr Ala Xaa' Ala Cys Thr Xaa' Xaa' Gly Cys (SEQ ID NO: 4371)
Pro Gly Thr Cys Gly Glu Ile Cys Ala Xaa' Tyr Ala Xaa' Ala Cys Thr Xaa' Gly Xaa' Cys (SEQ ID NO: 4372)
Pro Gly Thr Cys Gly Glu Ile Cys Ala Xaa' Tyr Ala Xaa' Ala Cys Thr Xaa' Gly Cys Xaa' (SEQ ID NO: 4373)
Pro Gly Thr Cys Gly Glu Ile Cys Ala Xaa' Tyr Ala Xaa' Ala Cys Thr Gly Xaa' Xaa' Cys (SEQ ID NO: 4374)
Pro Gly Thr Cys Gly Glu Ile Cys Ala Xaa' Tyr Ala Xaa' Ala Cys Thr Gly Xaa' Cys Xaa' (SEQ ID NO: 4375)
Pro Gly Thr Cys Gly Glu Ile Cys Ala Xaa' Tyr Ala Xaa' Ala Cys Thr Gly Cys Xaa' Xaa' (SEQ ID NO: 4376)
Pro Gly Thr Cys Gly Glu Ile Cys Ala Xaa' Tyr Ala Ala Xaa' Xaa' Cys Thr Gly Xaa' Cys (SEQ ID NO: 4377)
Pro Gly Thr Cys Gly Glu Ile Cys Ala Xaa' Tyr Ala Ala Xaa' Xaa' Cys Thr Gly Cys Xaa' (SEQ ID NO: 4378)
Pro Gly Thr Cys Gly Glu Ile Cys Ala Xaa' Tyr Ala Ala Xaa' Xaa' Xaa' Cys Thr Gly Cys (SEQ ID NO: 4379)
Pro Gly Thr Cys Gly Glu Ile Cys Ala Xaa' Tyr Ala Ala Xaa' Cys Xaa' Thr Gly Cys Xaa' (SEQ ID NO: 4380)
Pro Gly Thr Cys Gly Glu Ile Cys Ala Xaa' Tyr Ala Ala Ala Xaa' Xaa' Cys Thr Gly Cys (SEQ ID NO: 4381)
Pro Gly Thr Cys Gly Glu Ile Cys Ala Xaa' Tyr Ala Ala Ala Xaa' Cys Xaa' Thr Gly Cys (SEQ ID NO: 4382)
Pro Gly Thr Cys Gly Glu Ile Cys Ala Xaa' Tyr Ala Ala Ala Cys Xaa' Xaa' Thr Gly Cys (SEQ ID NO: 4383)
Pro Gly Thr Cys Gly Glu Ile Cys Ala Xaa' Tyr Ala Ala Ala Cys Xaa' Thr Xaa' Gly Cys (SEQ ID NO: 4384)
Pro Gly Thr Cys Gly Glu Ile Cys Ala Xaa' Tyr Ala Ala Ala Cys Xaa' Thr Gly Xaa' Cys (SEQ ID NO: 4385)
Pro Gly Thr Cys Gly Glu Ile Cys Ala Xaa' Tyr Ala Ala Ala Cys Xaa' Thr Gly Cys Xaa' (SEQ ID NO: 4386)
Pro Gly Thr Cys Gly Glu Ile Cys Ala Xaa' Tyr Ala Ala Ala Cys Thr Xaa' Xaa' Gly Cys (SEQ ID NO: 4387)
Pro Gly Thr Cys Gly Glu Ile Cys Ala Xaa' Tyr Ala Ala Ala Cys Thr Xaa' Gly Xaa' Cys (SEQ ID NO: 4388)
Pro Gly Thr Cys Gly Glu Ile Cys Ala Xaa' Tyr Ala Ala Ala Ala Xaa' Cys Thr Gly Cys (SEQ ID NO: 4389)
Pro Gly Thr Cys Gly Glu Ile Cys Ala Xaa' Tyr Ala Ala Ala Ala Cys Xaa' Thr Gly Cys (SEQ ID NO: 4390)

FIG. 2

```
Pro Gly Thr Cys Gly Glu Ile Cys Ala Xaa' Tyr Ala Ala Xaa' Cys Xaa' Thr Gly Cys Xaa'   (SEQ ID NO: 4391)
Pro Gly Thr Cys Gly Glu Ile Cys Ala Xaa' Tyr Ala Ala Xaa' Cys Thr Xaa' Gly Cys        (SEQ ID NO: 4392)
Pro Gly Thr Cys Gly Glu Ile Cys Ala Xaa' Tyr Ala Ala Xaa' Cys Thr Xaa' Xaa' Gly Cys   (SEQ ID NO: 4393)
Pro Gly Thr Cys Gly Glu Ile Cys Ala Xaa' Tyr Ala Ala Xaa' Cys Thr Xaa' Gly Xaa' Cys   (SEQ ID NO: 4394)
Pro Gly Thr Cys Gly Glu Ile Cys Ala Xaa' Tyr Ala Ala Xaa' Cys Thr Xaa' Gly Cys Xaa'   (SEQ ID NO: 4395)
Pro Gly Thr Cys Gly Glu Ile Cys Ala Xaa' Tyr Ala Ala Xaa' Cys Thr Gly Xaa' Cys        (SEQ ID NO: 4396)
Pro Gly Thr Cys Gly Glu Ile Cys Ala Xaa' Tyr Ala Ala Xaa' Cys Thr Gly Xaa' Xaa' Cys   (SEQ ID NO: 4397)
Pro Gly Thr Cys Gly Glu Ile Cys Ala Xaa' Tyr Ala Ala Xaa' Cys Thr Gly Xaa' Cys Xaa'   (SEQ ID NO: 4398)
Pro Gly Thr Cys Gly Glu Ile Cys Ala Xaa' Tyr Ala Ala Xaa' Cys Thr Gly Cys Xaa'        (SEQ ID NO: 4399)
Pro Gly Thr Cys Gly Glu Ile Cys Ala Xaa' Tyr Ala Ala Xaa' Cys Thr Gly Cys Xaa' Xaa'   (SEQ ID NO: 4400)
Pro Gly Thr Cys Gly Glu Ile Cys Ala Xaa' Tyr Ala Ala Cys Xaa' Xaa' Thr Gly Cys        (SEQ ID NO: 4401)
Pro Gly Thr Cys Gly Glu Ile Cys Ala Xaa' Tyr Ala Ala Cys Xaa' Xaa' Xaa' Thr Gly Cys   (SEQ ID NO: 4402)
Pro Gly Thr Cys Gly Glu Ile Cys Ala Xaa' Tyr Ala Ala Cys Xaa' Xaa' Thr Xaa' Gly Cys   (SEQ ID NO: 4403)
Pro Gly Thr Cys Gly Glu Ile Cys Ala Xaa' Tyr Ala Ala Cys Xaa' Xaa' Thr Gly Xaa' Cys   (SEQ ID NO: 4404)
Pro Gly Thr Cys Gly Glu Ile Cys Ala Xaa' Tyr Ala Ala Cys Xaa' Xaa' Thr Gly Cys Xaa'   (SEQ ID NO: 4405)
Pro Gly Thr Cys Gly Glu Ile Cys Ala Xaa' Tyr Ala Ala Cys Xaa' Thr Xaa' Gly Cys        (SEQ ID NO: 4406)
Pro Gly Thr Cys Gly Glu Ile Cys Ala Xaa' Tyr Ala Ala Cys Xaa' Thr Xaa' Xaa' Gly Cys   (SEQ ID NO: 4407)
Pro Gly Thr Cys Gly Glu Ile Cys Ala Xaa' Tyr Ala Ala Cys Xaa' Thr Xaa' Gly Xaa' Cys   (SEQ ID NO: 4408)
Pro Gly Thr Cys Gly Glu Ile Cys Ala Xaa' Tyr Ala Ala Cys Xaa' Thr Xaa' Gly Cys Xaa'   (SEQ ID NO: 4409)
Pro Gly Thr Cys Gly Glu Ile Cys Ala Xaa' Tyr Ala Ala Cys Xaa' Thr Gly Xaa' Cys        (SEQ ID NO: 4410)
Pro Gly Thr Cys Gly Glu Ile Cys Ala Xaa' Tyr Ala Ala Cys Xaa' Thr Gly Xaa' Xaa' Cys   (SEQ ID NO: 4411)
Pro Gly Thr Cys Gly Glu Ile Cys Ala Xaa' Tyr Ala Ala Cys Xaa' Thr Gly Xaa' Cys Xaa'   (SEQ ID NO: 4412)
Pro Gly Thr Cys Gly Glu Ile Cys Ala Xaa' Tyr Ala Ala Cys Xaa' Thr Gly Cys Xaa'        (SEQ ID NO: 4413)
Pro Gly Thr Cys Gly Glu Ile Cys Ala Xaa' Tyr Ala Ala Cys Xaa' Thr Gly Cys Xaa' Xaa'   (SEQ ID NO: 4414)
Pro Gly Thr Cys Gly Glu Ile Cys Ala Xaa' Tyr Ala Ala Cys Thr Xaa' Gly Cys Xaa'        (SEQ ID NO: 4415)
Pro Gly Thr Cys Gly Glu Ile Cys Ala Xaa' Tyr Ala Ala Cys Thr Xaa' Xaa' Gly Cys        (SEQ ID NO: 4416)
Pro Gly Thr Cys Gly Glu Ile Cys Ala Xaa' Tyr Ala Ala Cys Thr Xaa' Xaa' Xaa' Gly Cys   (SEQ ID NO: 4417)
Pro Gly Thr Cys Gly Glu Ile Cys Ala Xaa' Tyr Ala Ala Cys Thr Xaa' Xaa' Gly Xaa' Cys   (SEQ ID NO: 4418)
Pro Gly Thr Cys Gly Glu Ile Cys Ala Xaa' Tyr Ala Ala Cys Thr Xaa' Xaa' Gly Cys Xaa'   (SEQ ID NO: 4419)
Pro Gly Thr Cys Gly Glu Ile Cys Ala Xaa' Tyr Ala Ala Cys Thr Xaa' Gly Xaa' Cys        (SEQ ID NO: 4420)
Pro Gly Thr Cys Gly Glu Ile Cys Ala Xaa' Tyr Ala Ala Cys Thr Xaa' Gly Xaa' Xaa' Cys   (SEQ ID NO: 4421)
Pro Gly Thr Cys Gly Glu Ile Cys Ala Xaa' Tyr Ala Ala Cys Thr Xaa' Gly Xaa' Cys Xaa'   (SEQ ID NO: 4422)
Pro Gly Thr Cys Gly Glu Ile Cys Ala Xaa' Tyr Ala Ala Cys Thr Xaa' Gly Cys Xaa'        (SEQ ID NO: 4423)
Pro Gly Thr Cys Gly Glu Ile Cys Ala Xaa' Tyr Ala Ala Cys Thr Xaa' Gly Cys Xaa' Xaa'   (SEQ ID NO: 4424)
```

FIG. 2

| | | | | | | | | | | | | | | |
|---|---|---|---|---|---|---|---|---|---|---|---|---|---|---|
| Pro Gly Thr Cys Gly Glu Ile Cys Ala Xaa' Tyr Ala Ala Cys Thr Xaa' Gly Cys Xaa' Xaa' | (SEQ ID NO: 4425) |
| Pro Gly Thr Cys Gly Glu Ile Cys Ala Xaa' Tyr Ala Ala Cys Thr Gly Xaa' Cys | (SEQ ID NO: 4426) |
| Pro Gly Thr Cys Gly Glu Ile Cys Ala Xaa' Tyr Ala Ala Cys Thr Gly Xaa' Xaa' Cys | (SEQ ID NO: 4427) |
| Pro Gly Thr Cys Gly Glu Ile Cys Ala Xaa' Tyr Ala Ala Cys Thr Gly Xaa' Xaa' Cys | (SEQ ID NO: 4428) |
| Pro Gly Thr Cys Gly Glu Ile Cys Ala Xaa' Tyr Ala Ala Cys Thr Gly Xaa' Xaa' Cys Xaa' | (SEQ ID NO: 4429) |
| Pro Gly Thr Cys Gly Glu Ile Cys Ala Xaa' Tyr Ala Ala Cys Thr Gly Xaa' Xaa' Cys Xaa' | (SEQ ID NO: 4430) |
| Pro Gly Thr Cys Gly Glu Ile Cys Ala Xaa' Tyr Ala Ala Cys Thr Gly Xaa' Cys Xaa' Xaa' | (SEQ ID NO: 4431) |
| Pro Gly Thr Cys Gly Glu Ile Cys Ala Xaa' Tyr Ala Ala Cys Thr Gly Xaa' Cys Xaa' Xaa' | (SEQ ID NO: 4432) |
| Pro Gly Thr Cys Gly Glu Ile Cys Ala Xaa' Tyr Ala Ala Cys Thr Gly Cys Xaa' | (SEQ ID NO: 4433) |
| Pro Gly Thr Cys Gly Glu Ile Cys Ala Xaa' Tyr Ala Ala Cys Thr Gly Cys Xaa' Xaa' Xaa' | (SEQ ID NO: 4434) |
| Pro Gly Thr Cys Gly Glu Ile Cys Ala Xaa' Tyr Xaa' Ala Ala Cys Thr Gly Cys | (SEQ ID NO: 4435) |
| Pro Gly Thr Cys Gly Glu Ile Cys Ala Tyr Xaa' Ala Ala Cys Thr Gly Cys | (SEQ ID NO: 4436) |
| Pro Gly Thr Cys Gly Glu Ile Cys Ala Tyr Xaa' Xaa' Ala Ala Cys Thr Gly Cys | (SEQ ID NO: 4437) |
| Pro Gly Thr Cys Gly Glu Ile Cys Ala Tyr Xaa' Xaa' Xaa' Ala Ala Cys Thr Gly Cys | (SEQ ID NO: 4438) |
| Pro Gly Thr Cys Gly Glu Ile Cys Ala Tyr Xaa' Xaa' Xaa' Ala Ala Xaa' Ala Cys Thr Gly Cys | (SEQ ID NO: 4439) |
| Pro Gly Thr Cys Gly Glu Ile Cys Ala Tyr Xaa' Xaa' Xaa' Ala Ala Xaa' Ala Cys Thr Gly Cys | (SEQ ID NO: 4440) |
| Pro Gly Thr Cys Gly Glu Ile Cys Ala Tyr Xaa' Xaa' Xaa' Ala Ala Xaa' Ala Cys Thr Gly Cys | (SEQ ID NO: 4441) |
| Pro Gly Thr Cys Gly Glu Ile Cys Ala Tyr Xaa' Xaa' Xaa' Ala Ala Xaa' Ala Cys Thr Xaa' Gly Cys | (SEQ ID NO: 4442) |
| Pro Gly Thr Cys Gly Glu Ile Cys Ala Tyr Xaa' Xaa' Xaa' Ala Ala Xaa' Ala Cys Thr Gly Xaa' Cys | (SEQ ID NO: 4443) |
| Pro Gly Thr Cys Gly Glu Ile Cys Ala Tyr Xaa' Xaa' Xaa' Ala Ala Xaa' Ala Cys Thr Gly Cys Xaa' | (SEQ ID NO: 4444) |
| Pro Gly Thr Cys Gly Glu Ile Cys Ala Tyr Xaa' Xaa' Xaa' Ala Ala Xaa' Ala Cys Thr Gly Cys | (SEQ ID NO: 4445) |
| Pro Gly Thr Cys Gly Glu Ile Cys Ala Tyr Xaa' Xaa' Xaa' Ala Ala Xaa' Ala Xaa' Cys Thr Gly Cys | (SEQ ID NO: 4446) |
| Pro Gly Thr Cys Gly Glu Ile Cys Ala Tyr Xaa' Xaa' Xaa' Ala Ala Xaa' Ala Xaa' Cys Thr Gly Cys | (SEQ ID NO: 4447) |
| Pro Gly Thr Cys Gly Glu Ile Cys Ala Tyr Xaa' Xaa' Xaa' Ala Ala Xaa' Ala Xaa' Cys Thr Gly Cys | (SEQ ID NO: 4448) |
| Pro Gly Thr Cys Gly Glu Ile Cys Ala Tyr Xaa' Xaa' Xaa' Ala Ala Xaa' Ala Xaa' Cys Thr Xaa' Gly Cys | (SEQ ID NO: 4449) |
| Pro Gly Thr Cys Gly Glu Ile Cys Ala Tyr Xaa' Xaa' Xaa' Ala Ala Xaa' Ala Xaa' Cys Thr Gly Xaa' Cys | (SEQ ID NO: 4450) |
| Pro Gly Thr Cys Gly Glu Ile Cys Ala Tyr Xaa' Xaa' Xaa' Ala Ala Xaa' Ala Xaa' Cys Thr Gly Cys Xaa' | (SEQ ID NO: 4451) |
| Pro Gly Thr Cys Gly Glu Ile Cys Ala Tyr Xaa' Xaa' Xaa' Ala Ala Ala Xaa' Cys Thr Gly Cys | (SEQ ID NO: 4452) |
| Pro Gly Thr Cys Gly Glu Ile Cys Ala Tyr Xaa' Xaa' Xaa' Ala Ala Xaa' Cys Thr Gly Cys | (SEQ ID NO: 4453) |
| Pro Gly Thr Cys Gly Glu Ile Cys Ala Tyr Xaa' Xaa' Xaa' Ala Ala Xaa' Xaa' Cys Thr Gly Cys | (SEQ ID NO: 4454) |
| Pro Gly Thr Cys Gly Glu Ile Cys Ala Tyr Xaa' Xaa' Xaa' Ala Ala Xaa' Cys Xaa' Thr Gly Cys | (SEQ ID NO: 4455) |
| Pro Gly Thr Cys Gly Glu Ile Cys Ala Tyr Xaa' Xaa' Xaa' Ala Ala Xaa' Cys Thr Xaa' Gly Cys | (SEQ ID NO: 4456) |
| Pro Gly Thr Cys Gly Glu Ile Cys Ala Tyr Xaa' Xaa' Xaa' Ala Ala Xaa' Cys Thr Gly Xaa' Cys | (SEQ ID NO: 4457) |
| Pro Gly Thr Cys Gly Glu Ile Cys Ala Tyr Xaa' Xaa' Xaa' Ala Ala Xaa' Cys Thr Gly Cys Xaa' | (SEQ ID NO: 4458) |

FIG. 2

| Sequence | SEQ ID NO |
|---|---|
| Pro Gly Thr Cys Gly Glu Ile Cys Ala Tyr Xaa' Xaa' Ala Ala Cys Xaa' Xaa' Thr Gly Cys | (SEQID NO: 4459) |
| Pro Gly Thr Cys Gly Glu Ile Cys Ala Tyr Xaa' Xaa' Ala Ala Cys Xaa' Xaa' Thr Xaa' Gly Cys | (SEQID NO: 4460) |
| Pro Gly Thr Cys Gly Glu Ile Cys Ala Tyr Xaa' Xaa' Ala Ala Cys Xaa' Xaa' Thr Gly Xaa' Cys | (SEQID NO: 4461) |
| Pro Gly Thr Cys Gly Glu Ile Cys Ala Tyr Xaa' Xaa' Ala Ala Cys Xaa' Xaa' Thr Gly Cys Xaa' | (SEQID NO: 4462) |
| Pro Gly Thr Cys Gly Glu Ile Cys Ala Tyr Xaa' Xaa' Ala Ala Cys Xaa' Thr Xaa' Gly Cys | (SEQID NO: 4463) |
| Pro Gly Thr Cys Gly Glu Ile Cys Ala Tyr Xaa' Xaa' Ala Ala Cys Xaa' Thr Xaa' Xaa' Gly Cys | (SEQID NO: 4464) |
| Pro Gly Thr Cys Gly Glu Ile Cys Ala Tyr Xaa' Xaa' Ala Ala Cys Xaa' Thr Xaa' Gly Xaa' Cys | (SEQID NO: 4465) |
| Pro Gly Thr Cys Gly Glu Ile Cys Ala Tyr Xaa' Xaa' Ala Ala Cys Xaa' Thr Xaa' Gly Cys Xaa' | (SEQID NO: 4466) |
| Pro Gly Thr Cys Gly Glu Ile Cys Ala Tyr Xaa' Xaa' Ala Ala Cys Xaa' Thr Gly Xaa' Cys | (SEQID NO: 4467) |
| Pro Gly Thr Cys Gly Glu Ile Cys Ala Tyr Xaa' Xaa' Ala Ala Cys Xaa' Thr Gly Xaa' Xaa' Cys | (SEQID NO: 4468) |
| Pro Gly Thr Cys Gly Glu Ile Cys Ala Tyr Xaa' Xaa' Ala Ala Cys Xaa' Thr Gly Cys Xaa' | (SEQID NO: 4469) |
| Pro Gly Thr Cys Gly Glu Ile Cys Ala Tyr Xaa' Xaa' Ala Ala Cys Xaa' Thr Gly Cys Xaa' | (SEQID NO: 4470) |
| Pro Gly Thr Cys Gly Glu Ile Cys Ala Tyr Xaa' Xaa' Ala Ala Cys Xaa' Thr Gly Xaa' Cys | (SEQID NO: 4471) |
| Pro Gly Thr Cys Gly Glu Ile Cys Ala Tyr Xaa' Ala Xaa' Xaa' Ala Cys Thr Gly Cys | (SEQID NO: 4472) |
| Pro Gly Thr Cys Gly Glu Ile Cys Ala Tyr Xaa' Ala Xaa' Xaa' Ala Cys Thr Gly Cys | (SEQID NO: 4473) |
| Pro Gly Thr Cys Gly Glu Ile Cys Ala Tyr Xaa' Xaa' Ala Xaa' Ala Cys Thr Cys Thr Gly Cys | (SEQID NO: 4474) |
| Pro Gly Thr Cys Gly Glu Ile Cys Ala Tyr Xaa' Xaa' Ala Xaa' Ala Cys Xaa' Thr Gly Cys | (SEQID NO: 4475) |
| Pro Gly Thr Cys Gly Glu Ile Cys Ala Tyr Xaa' Xaa' Ala Xaa' Ala Cys Xaa' Thr Xaa' Gly Cys | (SEQID NO: 4476) |
| Pro Gly Thr Cys Gly Glu Ile Cys Ala Tyr Xaa' Xaa' Ala Xaa' Ala Cys Xaa' Thr Gly Xaa' Cys | (SEQID NO: 4477) |
| Pro Gly Thr Cys Gly Glu Ile Cys Ala Tyr Xaa' Xaa' Ala Xaa' Ala Cys Xaa' Thr Gly Cys Xaa' | (SEQID NO: 4478) |
| Pro Gly Thr Cys Gly Glu Ile Cys Ala Tyr Xaa' Xaa' Ala Xaa' Ala Cys Thr Xaa' Gly Cys | (SEQID NO: 4479) |
| Pro Gly Thr Cys Gly Glu Ile Cys Ala Tyr Xaa' Xaa' Ala Xaa' Ala Cys Thr Xaa' Xaa' Gly Cys | (SEQID NO: 4480) |
| Pro Gly Thr Cys Gly Glu Ile Cys Ala Tyr Xaa' Xaa' Ala Xaa' Ala Cys Xaa' Cys Thr Gly Cys | (SEQID NO: 4481) |
| Pro Gly Thr Cys Gly Glu Ile Cys Ala Tyr Xaa' Xaa' Ala Xaa' Ala Cys Xaa' Cys Xaa' Thr Gly Cys | (SEQID NO: 4482) |
| Pro Gly Thr Cys Gly Glu Ile Cys Ala Tyr Xaa' Xaa' Ala Xaa' Ala Cys Xaa' Cys Thr Gly Xaa' Cys | (SEQID NO: 4483) |
| Pro Gly Thr Cys Gly Glu Ile Cys Ala Tyr Xaa' Xaa' Ala Xaa' Ala Cys Xaa' Cys Thr Gly Cys Xaa' | (SEQID NO: 4484) |
| Pro Gly Thr Cys Gly Glu Ile Cys Ala Tyr Xaa' Xaa' Ala Xaa' Ala Cys Xaa' Cys Thr Gly Cys Xaa' | (SEQID NO: 4485) |
| Pro Gly Thr Cys Gly Glu Ile Cys Ala Tyr Xaa' Xaa' Ala Xaa' Ala Cys Xaa' Cys Xaa' Thr Gly Cys | (SEQID NO: 4486) |
| Pro Gly Thr Cys Gly Glu Ile Cys Ala Tyr Xaa' Xaa' Ala Xaa' Ala Cys Xaa' Cys Thr Xaa' Gly Cys | (SEQID NO: 4487) |
| Pro Gly Thr Cys Gly Glu Ile Cys Ala Tyr Xaa' Xaa' Ala Xaa' Ala Cys Xaa' Cys Thr Gly Xaa' Cys | (SEQID NO: 4488) |
| Pro Gly Thr Cys Gly Glu Ile Cys Ala Tyr Xaa' Xaa' Ala Xaa' Ala Cys Xaa' Cys Thr Gly Cys Xaa' | (SEQID NO: 4489) |
| Pro Gly Thr Cys Gly Glu Ile Cys Ala Tyr Xaa' Xaa' Ala Xaa' Ala Cys Thr Xaa' Gly Cys | (SEQID NO: 4490) |
| Pro Gly Thr Cys Gly Glu Ile Cys Ala Tyr Xaa' Xaa' Ala Xaa' Ala Cys Thr Xaa' Gly Cys | (SEQID NO: 4491) |
| Pro Gly Thr Cys Gly Glu Ile Cys Ala Tyr Xaa' Ala Xaa' Ala Xaa' Cys Thr Xaa' Xaa' Gly Cys | (SEQID NO: 4492) |

FIG. 2

Pro Gly Thr Cys Gly Glu Ile Cys Ala Tyr Xaa' Ala Xaa' Ala Cys Thr Xaa' Gly Xaa' Cys (SEQID NO: 4493 )
Pro Gly Thr Cys Gly Glu Ile Cys Ala Tyr Xaa' Ala Xaa' Ala Cys Thr Xaa' Gly Cys Xaa' (SEQID NO: 4494 )
Pro Gly Thr Cys Gly Glu Ile Cys Ala Tyr Xaa' Ala Xaa' Ala Cys Thr Gly Xaa' Cys (SEQID NO: 4495 )
Pro Gly Thr Cys Gly Glu Ile Cys Ala Tyr Xaa' Ala Xaa' Ala Cys Thr Gly Xaa' Xaa' Cys (SEQID NO: 4496 )
Pro Gly Thr Cys Gly Glu Ile Cys Ala Tyr Xaa' Ala Xaa' Ala Cys Thr Gly Xaa' Cys Xaa' (SEQID NO: 4497 )
Pro Gly Thr Cys Gly Glu Ile Cys Ala Tyr Xaa' Ala Xaa' Ala Cys Thr Gly Cys Xaa' (SEQID NO: 4498 )
Pro Gly Thr Cys Gly Glu Ile Cys Ala Tyr Xaa' Ala Xaa' Ala Cys Thr Gly Cys Xaa' Xaa' (SEQID NO: 4499 )
Pro Gly Thr Cys Gly Glu Ile Cys Ala Tyr Xaa' Ala Ala Xaa' Cys Thr Gly Cys (SEQID NO: 4500 )
Pro Gly Thr Cys Gly Glu Ile Cys Ala Tyr Xaa' Ala Ala Xaa' Xaa' Cys Thr Gly Cys (SEQID NO: 4501 )
Pro Gly Thr Cys Gly Glu Ile Cys Ala Tyr Xaa' Ala Ala Xaa' Xaa' Xaa' Cys Thr Gly Cys (SEQID NO: 4502 )
Pro Gly Thr Cys Gly Glu Ile Cys Ala Tyr Xaa' Ala Ala Xaa' Xaa' Cys Xaa' Thr Gly Cys (SEQID NO: 4503 )
Pro Gly Thr Cys Gly Glu Ile Cys Ala Tyr Xaa' Ala Ala Xaa' Xaa' Cys Thr Xaa' Gly Cys (SEQID NO: 4504 )
Pro Gly Thr Cys Gly Glu Ile Cys Ala Tyr Xaa' Ala Ala Xaa' Xaa' Cys Thr Gly Xaa' Cys (SEQID NO: 4505 )
Pro Gly Thr Cys Gly Glu Ile Cys Ala Tyr Xaa' Ala Ala Xaa' Xaa' Cys Thr Gly Cys Xaa' (SEQID NO: 4506 )
Pro Gly Thr Cys Gly Glu Ile Cys Ala Tyr Xaa' Ala Ala Xaa' Cys Xaa' Thr Gly Cys (SEQID NO: 4507 )
Pro Gly Thr Cys Gly Glu Ile Cys Ala Tyr Xaa' Ala Ala Xaa' Cys Xaa' Xaa' Thr Gly Cys (SEQID NO: 4508 )
Pro Gly Thr Cys Gly Glu Ile Cys Ala Tyr Xaa' Ala Ala Xaa' Cys Xaa' Thr Xaa' Gly Cys (SEQID NO: 4509 )
Pro Gly Thr Cys Gly Glu Ile Cys Ala Tyr Xaa' Ala Ala Xaa' Cys Xaa' Thr Gly Xaa' Cys (SEQID NO: 4510 )
Pro Gly Thr Cys Gly Glu Ile Cys Ala Tyr Xaa' Ala Ala Xaa' Cys Xaa' Thr Gly Cys Xaa' (SEQID NO: 4511 )
Pro Gly Thr Cys Gly Glu Ile Cys Ala Tyr Xaa' Ala Ala Xaa' Cys Thr Xaa' Gly Cys (SEQID NO: 4512 )
Pro Gly Thr Cys Gly Glu Ile Cys Ala Tyr Xaa' Ala Ala Xaa' Cys Thr Xaa' Xaa' Gly Cys (SEQID NO: 4513 )
Pro Gly Thr Cys Gly Glu Ile Cys Ala Tyr Xaa' Ala Ala Xaa' Cys Thr Xaa' Gly Xaa' Cys (SEQID NO: 4514 )
Pro Gly Thr Cys Gly Glu Ile Cys Ala Tyr Xaa' Ala Ala Xaa' Cys Thr Xaa' Gly Cys Xaa' (SEQID NO: 4515 )
Pro Gly Thr Cys Gly Glu Ile Cys Ala Tyr Xaa' Ala Ala Xaa' Cys Thr Gly Xaa' Cys (SEQID NO: 4516 )
Pro Gly Thr Cys Gly Glu Ile Cys Ala Tyr Xaa' Ala Ala Xaa' Cys Thr Gly Xaa' Xaa' Cys (SEQID NO: 4517 )
Pro Gly Thr Cys Gly Glu Ile Cys Ala Tyr Xaa' Ala Ala Xaa' Cys Thr Gly Xaa' Cys Xaa' (SEQID NO: 4518 )
Pro Gly Thr Cys Gly Glu Ile Cys Ala Tyr Xaa' Ala Ala Xaa' Cys Thr Gly Cys Xaa' (SEQID NO: 4519 )
Pro Gly Thr Cys Gly Glu Ile Cys Ala Tyr Xaa' Ala Ala Xaa' Cys Thr Gly Cys Xaa' Xaa' (SEQID NO: 4520 )
Pro Gly Thr Cys Gly Glu Ile Cys Ala Tyr Xaa' Ala Ala Cys Xaa' Thr Gly Cys (SEQID NO: 4521 )
Pro Gly Thr Cys Gly Glu Ile Cys Ala Tyr Xaa' Ala Ala Cys Xaa' Xaa' Thr Gly Cys (SEQID NO: 4522 )
Pro Gly Thr Cys Gly Glu Ile Cys Ala Tyr Xaa' Ala Ala Cys Xaa' Xaa' Xaa' Thr Gly Cys (SEQID NO: 4523 )
Pro Gly Thr Cys Gly Glu Ile Cys Ala Tyr Xaa' Ala Ala Cys Xaa' Xaa' Thr Xaa' Gly Cys (SEQID NO: 4524 )
Pro Gly Thr Cys Gly Glu Ile Cys Ala Tyr Xaa' Ala Ala Cys Xaa' Xaa' Thr Gly Xaa' Cys (SEQID NO: 4525 )
Pro Gly Thr Cys Gly Glu Ile Cys Ala Tyr Xaa' Ala Ala Cys Xaa' Xaa' Thr Gly Cys Xaa' (SEQID NO: 4526 )

FIG. 2

| | | | | | | | | | | | | | | |
|---|---|---|---|---|---|---|---|---|---|---|---|---|---|---|
| Pro | Gly | Thr | Cys | Gly | Glu | Ile | Cys | Ala | Tyr | Ala | Ala | Cys | Xaa | Thr | Xaa' | Gly | Cys | (SEQ ID NO: 4527) |
| Pro | Gly | Thr | Cys | Gly | Glu | Ile | Cys | Ala | Tyr | Ala | Ala | Cys | Xaa | Thr | Xaa' | Xaa' | Gly | Cys | (SEQ ID NO: 4528) |
| Pro | Gly | Thr | Cys | Gly | Glu | Ile | Cys | Ala | Tyr | Ala | Ala | Cys | Xaa | Thr | Xaa' | Gly | Xaa' | Cys | (SEQ ID NO: 4529) |
| Pro | Gly | Thr | Cys | Gly | Glu | Ile | Cys | Ala | Tyr | Ala | Ala | Cys | Xaa | Thr | Xaa' | Gly | Cys | Xaa' | (SEQ ID NO: 4530) |
| Pro | Gly | Thr | Cys | Gly | Glu | Ile | Cys | Ala | Tyr | Ala | Ala | Cys | Xaa | Thr | Gly | Xaa' | Cys | (SEQ ID NO: 4531) |
| Pro | Gly | Thr | Cys | Gly | Glu | Ile | Cys | Ala | Tyr | Ala | Ala | Cys | Xaa | Thr | Gly | Xaa' | Xaa' | Cys | (SEQ ID NO: 4532) |
| Pro | Gly | Thr | Cys | Gly | Glu | Ile | Cys | Ala | Tyr | Ala | Ala | Cys | Xaa | Thr | Gly | Xaa' | Cys | Xaa' | (SEQ ID NO: 4533) |
| Pro | Gly | Thr | Cys | Gly | Glu | Ile | Cys | Ala | Tyr | Ala | Ala | Cys | Xaa | Thr | Gly | Cys | Xaa' | (SEQ ID NO: 4534) |
| Pro | Gly | Thr | Cys | Gly | Glu | Ile | Cys | Ala | Tyr | Ala | Ala | Cys | Xaa | Thr | Gly | Cys | Xaa' | Xaa' | (SEQ ID NO: 4535) |
| Pro | Gly | Thr | Cys | Gly | Glu | Ile | Cys | Ala | Tyr | Ala | Ala | Cys | Xaa | Thr | Xaa' | Gly | Cys | (SEQ ID NO: 4536) |
| Pro | Gly | Thr | Cys | Gly | Glu | Ile | Cys | Ala | Tyr | Ala | Ala | Cys | Xaa | Thr | Xaa' | Xaa' | Gly | Cys | (SEQ ID NO: 4537) |
| Pro | Gly | Thr | Cys | Gly | Glu | Ile | Cys | Ala | Tyr | Ala | Ala | Cys | Xaa | Thr | Xaa' | Xaa' | Xaa' | Gly | Cys | (SEQ ID NO: 4538) |
| Pro | Gly | Thr | Cys | Gly | Glu | Ile | Cys | Ala | Tyr | Ala | Ala | Cys | Xaa | Thr | Xaa' | Xaa' | Gly | Xaa' | Cys | (SEQ ID NO: 4539) |
| Pro | Gly | Thr | Cys | Gly | Glu | Ile | Cys | Ala | Tyr | Ala | Ala | Cys | Xaa | Thr | Xaa' | Xaa' | Gly | Cys | Xaa' | (SEQ ID NO: 4540) |
| Pro | Gly | Thr | Cys | Gly | Glu | Ile | Cys | Ala | Tyr | Ala | Ala | Cys | Xaa | Thr | Xaa' | Gly | Xaa' | Cys | (SEQ ID NO: 4541) |
| Pro | Gly | Thr | Cys | Gly | Glu | Ile | Cys | Ala | Tyr | Ala | Ala | Cys | Xaa | Thr | Xaa' | Gly | Xaa' | Xaa' | Cys | (SEQ ID NO: 4542) |
| Pro | Gly | Thr | Cys | Gly | Glu | Ile | Cys | Ala | Tyr | Ala | Ala | Cys | Xaa | Thr | Xaa' | Gly | Xaa' | Cys | Xaa' | (SEQ ID NO: 4543) |
| Pro | Gly | Thr | Cys | Gly | Glu | Ile | Cys | Ala | Tyr | Ala | Ala | Cys | Xaa | Thr | Xaa' | Gly | Cys | Xaa' | (SEQ ID NO: 4544) |
| Pro | Gly | Thr | Cys | Gly | Glu | Ile | Cys | Ala | Tyr | Ala | Ala | Cys | Xaa | Thr | Xaa' | Gly | Cys | Xaa' | Xaa' | (SEQ ID NO: 4545) |
| Pro | Gly | Thr | Cys | Gly | Glu | Ile | Cys | Ala | Tyr | Ala | Ala | Cys | Xaa | Thr | Gly | Xaa' | Cys | (SEQ ID NO: 4546) |
| Pro | Gly | Thr | Cys | Gly | Glu | Ile | Cys | Ala | Tyr | Ala | Ala | Cys | Xaa | Thr | Gly | Xaa' | Xaa' | Cys | (SEQ ID NO: 4547) |
| Pro | Gly | Thr | Cys | Gly | Glu | Ile | Cys | Ala | Tyr | Ala | Ala | Cys | Xaa | Thr | Gly | Xaa' | Xaa' | Xaa' | Cys | (SEQ ID NO: 4548) |
| Pro | Gly | Thr | Cys | Gly | Glu | Ile | Cys | Ala | Tyr | Ala | Ala | Cys | Xaa | Thr | Gly | Xaa' | Xaa' | Cys | Xaa' | (SEQ ID NO: 4549) |
| Pro | Gly | Thr | Cys | Gly | Glu | Ile | Cys | Ala | Tyr | Ala | Ala | Cys | Xaa | Thr | Gly | Xaa' | Cys | Xaa' | (SEQ ID NO: 4550) |
| Pro | Gly | Thr | Cys | Gly | Glu | Ile | Cys | Ala | Tyr | Ala | Ala | Cys | Xaa | Thr | Gly | Xaa' | Cys | Xaa' | Xaa' | (SEQ ID NO: 4551) |
| Pro | Gly | Thr | Cys | Gly | Glu | Ile | Cys | Ala | Tyr | Ala | Ala | Cys | Xaa | Thr | Gly | Cys | Xaa' | (SEQ ID NO: 4552) |
| Pro | Gly | Thr | Cys | Gly | Glu | Ile | Cys | Ala | Tyr | Ala | Ala | Cys | Xaa | Thr | Gly | Cys | Xaa' | Xaa' | (SEQ ID NO: 4553) |
| Pro | Gly | Thr | Cys | Gly | Glu | Ile | Cys | Ala | Tyr | Ala | Ala | Cys | Xaa | Thr | Gly | Cys | Xaa' | Xaa' | Xaa' | (SEQ ID NO: 4554) |
| Pro | Gly | Thr | Cys | Gly | Glu | Ile | Cys | Ala | Tyr | Ala | Xaa' | Ala | Cys | Thr | Gly | Cys | (SEQ ID NO: 4555) |
| Pro | Gly | Thr | Cys | Gly | Glu | Ile | Cys | Ala | Tyr | Ala | Xaa' | Xaa' | Ala | Cys | Thr | Gly | Cys | (SEQ ID NO: 4556) |
| Pro | Gly | Thr | Cys | Gly | Glu | Ile | Cys | Ala | Tyr | Ala | Xaa' | Xaa' | Xaa' | Ala | Cys | Thr | Gly | Cys | (SEQ ID NO: 4557) |
| Pro | Gly | Thr | Cys | Gly | Glu | Ile | Cys | Ala | Tyr | Ala | Xaa' | Xaa' | Xaa' | Xaa' | Ala | Cys | Thr | Gly | Cys | (SEQ ID NO: 4558) |
| Pro | Gly | Thr | Cys | Gly | Glu | Ile | Cys | Ala | Tyr | Ala | Xaa' | Ala | Xaa' | Cys | Thr | Gly | Cys | (SEQ ID NO: 4559) |
| Pro | Gly | Thr | Cys | Gly | Glu | Ile | Cys | Ala | Tyr | Ala | Xaa' | Ala | Cys | Xaa' | Thr | Gly | Cys | (SEQ ID NO: 4560) |

FIG. 2

| Sequence | SEQ ID NO |
|---|---|
| Pro Gly Thr Cys Gly Glu Ile Cys Ala Tyr Ala Xaa' Xaa' Ala Cys Thr Xaa' Gly Cys | (SEQID NO: 4561) |
| Pro Gly Thr Cys Gly Glu Ile Cys Ala Tyr Ala Xaa' Xaa' Ala Cys Thr Gly Xaa' Cys | (SEQID NO: 4562) |
| Pro Gly Thr Cys Gly Glu Ile Cys Ala Tyr Ala Xaa' Xaa' Ala Cys Thr Gly Cys Xaa' | (SEQID NO: 4563) |
| Pro Gly Thr Cys Gly Glu Ile Cys Ala Tyr Ala Xaa' Xaa' Ala Xaa' Cys Thr Gly Cys | (SEQID NO: 4564) |
| Pro Gly Thr Cys Gly Glu Ile Cys Ala Tyr Ala Xaa' Xaa' Xaa' Ala Cys Thr Gly Cys | (SEQID NO: 4565) |
| Pro Gly Thr Cys Gly Glu Ile Cys Ala Tyr Ala Xaa' Xaa' Ala Xaa' Cys Xaa' Thr Gly Cys | (SEQID NO: 4566) |
| Pro Gly Thr Cys Gly Glu Ile Cys Ala Tyr Ala Xaa' Xaa' Ala Xaa' Cys Thr Xaa' Gly Cys | (SEQID NO: 4567) |
| Pro Gly Thr Cys Gly Glu Ile Cys Ala Tyr Ala Xaa' Xaa' Ala Xaa' Cys Thr Gly Xaa' Cys | (SEQID NO: 4568) |
| Pro Gly Thr Cys Gly Glu Ile Cys Ala Tyr Ala Xaa' Xaa' Ala Xaa' Cys Thr Gly Cys Xaa' | (SEQID NO: 4569) |
| Pro Gly Thr Cys Gly Glu Ile Cys Ala Tyr Ala Xaa' Xaa' Xaa' Ala Cys Xaa' Thr Gly Cys | (SEQID NO: 4570) |
| Pro Gly Thr Cys Gly Glu Ile Cys Ala Tyr Ala Xaa' Xaa' Xaa' Ala Cys Thr Xaa' Gly Cys | (SEQID NO: 4571) |
| Pro Gly Thr Cys Gly Glu Ile Cys Ala Tyr Ala Xaa' Xaa' Xaa' Ala Cys Thr Gly Xaa' Cys | (SEQID NO: 4572) |
| Pro Gly Thr Cys Gly Glu Ile Cys Ala Tyr Ala Xaa' Xaa' Xaa' Ala Cys Thr Gly Cys Xaa' | (SEQID NO: 4573) |
| Pro Gly Thr Cys Gly Glu Ile Cys Ala Tyr Ala Xaa' Xaa' Ala Cys Xaa' Thr Gly Cys | (SEQID NO: 4574) |
| Pro Gly Thr Cys Gly Glu Ile Cys Ala Tyr Ala Xaa' Xaa' Ala Cys Xaa' Thr Gly Cys Xaa' | (SEQID NO: 4575) |
| Pro Gly Thr Cys Gly Glu Ile Cys Ala Tyr Ala Xaa' Xaa' Ala Cys Xaa' Xaa' Thr Gly Cys | (SEQID NO: 4576) |
| Pro Gly Thr Cys Gly Glu Ile Cys Ala Tyr Ala Xaa' Xaa' Ala Cys Xaa' Thr Xaa' Gly Cys | (SEQID NO: 4577) |
| Pro Gly Thr Cys Gly Glu Ile Cys Ala Tyr Ala Xaa' Xaa' Ala Cys Xaa' Thr Gly Xaa' Cys | (SEQID NO: 4578) |
| Pro Gly Thr Cys Gly Glu Ile Cys Ala Tyr Ala Xaa' Xaa' Ala Cys Thr Gly Xaa' Cys | (SEQID NO: 4579) |
| Pro Gly Thr Cys Gly Glu Ile Cys Ala Tyr Ala Xaa' Xaa' Ala Cys Thr Gly Xaa' Xaa' Cys | (SEQID NO: 4580) |
| Pro Gly Thr Cys Gly Glu Ile Cys Ala Tyr Ala Xaa' Xaa' Ala Cys Xaa' Thr Gly Xaa' Cys | (SEQID NO: 4581) |
| Pro Gly Thr Cys Gly Glu Ile Cys Ala Tyr Ala Xaa' Xaa' Ala Cys Thr Xaa' Gly Xaa' Cys | (SEQID NO: 4582) |
| Pro Gly Thr Cys Gly Glu Ile Cys Ala Tyr Ala Xaa' Xaa' Ala Cys Thr Gly Xaa' Cys Xaa' | (SEQID NO: 4583) |
| Pro Gly Thr Cys Gly Glu Ile Cys Ala Tyr Ala Xaa' Ala Xaa' Cys Thr Gly Cys | (SEQID NO: 4584) |
| Pro Gly Thr Cys Gly Glu Ile Cys Ala Tyr Ala Xaa' Ala Xaa' Cys Xaa' Thr Gly Cys | (SEQID NO: 4585) |
| Pro Gly Thr Cys Gly Glu Ile Cys Ala Tyr Ala Xaa' Ala Xaa' Cys Thr Xaa' Gly Cys | (SEQID NO: 4586) |
| Pro Gly Thr Cys Gly Glu Ile Cys Ala Tyr Ala Xaa' Ala Xaa' Cys Thr Gly Xaa' Cys | (SEQID NO: 4587) |
| Pro Gly Thr Cys Gly Glu Ile Cys Ala Tyr Ala Xaa' Ala Xaa' Cys Thr Gly Cys Xaa' | (SEQID NO: 4588) |
| Pro Gly Thr Cys Gly Glu Ile Cys Ala Tyr Ala Xaa' Ala Xaa' Xaa' Cys Thr Gly Cys | (SEQID NO: 4589) |
| Pro Gly Thr Cys Gly Glu Ile Cys Ala Tyr Ala Xaa' Ala Xaa' Cys Xaa' Thr Gly Xaa' Cys | (SEQID NO: 4590) |
| Pro Gly Thr Cys Gly Glu Ile Cys Ala Tyr Ala Xaa' Ala Xaa' Cys Xaa' Xaa' Thr Gly Cys | (SEQID NO: 4591) |
| Pro Gly Thr Cys Gly Glu Ile Cys Ala Tyr Ala Xaa' Ala Xaa' Cys Xaa' Thr Xaa' Gly Cys | (SEQID NO: 4592) |
| Pro Gly Thr Cys Gly Glu Ile Cys Ala Tyr Ala Xaa' Ala Xaa' Cys Xaa' Thr Gly Xaa' Cys | (SEQID NO: 4593) |
| Pro Gly Thr Cys Gly Glu Ile Cys Ala Tyr Ala Xaa' Ala Xaa' Cys Xaa' Thr Gly Xaa' Cys | (SEQID NO: 4594) |

FIG. 2

```
Pro Gly Thr Cys Gly Glu Ile Cys Ala Tyr Ala Xaa' Cys Xaa' Thr Gly Cys Xaa'     (SEQID NO: 4595)
Pro Gly Thr Cys Gly Glu Ile Cys Ala Tyr Ala Xaa' Ala Xaa' Thr Xaa' Gly Cys     (SEQID NO: 4596)
Pro Gly Thr Cys Gly Glu Ile Cys Ala Tyr Ala Xaa' Ala Xaa' Cys Xaa' Gly Cys     (SEQID NO: 4597)
Pro Gly Thr Cys Gly Glu Ile Cys Ala Tyr Ala Xaa' Ala Xaa' Cys Thr Xaa' Cys     (SEQID NO: 4598)
Pro Gly Thr Cys Gly Glu Ile Cys Ala Tyr Ala Xaa' Ala Xaa' Cys Thr Gly Xaa'     (SEQID NO: 4599)
Pro Gly Thr Cys Gly Glu Ile Cys Ala Tyr Ala Xaa' Ala Xaa' Cys Thr Gly Cys      (SEQID NO: 4600)
Pro Gly Thr Cys Gly Glu Ile Cys Ala Tyr Ala Xaa' Cys Xaa' Thr Gly Xaa' Cys     (SEQID NO: 4601)
Pro Gly Thr Cys Gly Glu Ile Cys Ala Tyr Ala Xaa' Cys Xaa' Thr Gly Xaa' Xaa'    (SEQID NO: 4602)
Pro Gly Thr Cys Gly Glu Ile Cys Ala Tyr Ala Xaa' Cys Xaa' Thr Gly Cys Xaa'     (SEQID NO: 4603)
Pro Gly Thr Cys Gly Glu Ile Cys Ala Tyr Ala Xaa' Ala Xaa' Thr Gly Cys Xaa'     (SEQID NO: 4604)
Pro Gly Thr Cys Gly Glu Ile Cys Ala Tyr Ala Xaa' Ala Cys Xaa' Thr Gly Cys      (SEQID NO: 4605)
Pro Gly Thr Cys Gly Glu Ile Cys Ala Tyr Ala Xaa' Ala Cys Xaa' Thr Gly Cys      (SEQID NO: 4606)
Pro Gly Thr Cys Gly Glu Ile Cys Ala Tyr Ala Xaa' Ala Cys Xaa' Xaa' Thr Gly Cys (SEQID NO: 4607)
Pro Gly Thr Cys Gly Glu Ile Cys Ala Tyr Ala Xaa' Ala Cys Xaa' Xaa' Gly Cys     (SEQID NO: 4608)
Pro Gly Thr Cys Gly Glu Ile Cys Ala Tyr Ala Xaa' Ala Cys Xaa' Xaa' Thr Gly Cys (SEQID NO: 4609)
Pro Gly Thr Cys Gly Glu Ile Cys Ala Tyr Ala Xaa' Ala Cys Xaa' Xaa' Thr Gly Xaa'(SEQID NO: 4610)
Pro Gly Thr Cys Gly Glu Ile Cys Ala Tyr Ala Xaa' Ala Cys Xaa' Thr Gly Cys      (SEQID NO: 4611)
Pro Gly Thr Cys Gly Glu Ile Cys Ala Tyr Ala Xaa' Ala Cys Xaa' Thr Xaa' Gly Cys (SEQID NO: 4612)
Pro Gly Thr Cys Gly Glu Ile Cys Ala Tyr Ala Xaa' Ala Cys Xaa' Thr Gly Xaa' Cys (SEQID NO: 4613)
Pro Gly Thr Cys Gly Glu Ile Cys Ala Tyr Ala Xaa' Ala Cys Xaa' Thr Gly Xaa' Xaa'(SEQID NO: 4614)
Pro Gly Thr Cys Gly Glu Ile Cys Ala Tyr Ala Xaa' Ala Cys Xaa' Thr Gly Cys Xaa' (SEQID NO: 4615)
Pro Gly Thr Cys Gly Glu Ile Cys Ala Tyr Ala Xaa' Ala Cys Thr Xaa' Xaa' Gly Cys (SEQID NO: 4616)
Pro Gly Thr Cys Gly Glu Ile Cys Ala Tyr Ala Xaa' Ala Cys Thr Xaa' Gly Xaa' Cys (SEQID NO: 4617)
Pro Gly Thr Cys Gly Glu Ile Cys Ala Tyr Ala Xaa' Ala Cys Thr Xaa' Gly Cys Xaa' (SEQID NO: 4618)
Pro Gly Thr Cys Gly Glu Ile Cys Ala Tyr Ala Xaa' Ala Cys Thr Xaa' Gly Xaa' Xaa'(SEQID NO: 4619)
Pro Gly Thr Cys Gly Glu Ile Cys Ala Tyr Ala Xaa' Ala Cys Thr Xaa' Gly Cys      (SEQID NO: 4620)
Pro Gly Thr Cys Gly Glu Ile Cys Ala Tyr Ala Xaa' Ala Cys Thr Xaa' Xaa' Gly Cys (SEQID NO: 4621)
Pro Gly Thr Cys Gly Glu Ile Cys Ala Tyr Ala Xaa' Ala Cys Thr Xaa' Xaa' Gly Cys (SEQID NO: 4622)
Pro Gly Thr Cys Gly Glu Ile Cys Ala Tyr Ala Xaa' Ala Cys Thr Xaa' Gly Xaa' Cys (SEQID NO: 4623)
Pro Gly Thr Cys Gly Glu Ile Cys Ala Tyr Ala Xaa' Ala Cys Thr Xaa' Gly Cys Xaa' (SEQID NO: 4624)
Pro Gly Thr Cys Gly Glu Ile Cys Ala Tyr Ala Xaa' Ala Cys Thr Gly Xaa' Cys      (SEQID NO: 4625)
Pro Gly Thr Cys Gly Glu Ile Cys Ala Tyr Ala Xaa' Ala Cys Thr Gly Xaa' Xaa' Cys (SEQID NO: 4626)
Pro Gly Thr Cys Gly Glu Ile Cys Ala Tyr Ala Xaa' Ala Cys Thr Gly Xaa' Cys Xaa' (SEQID NO: 4627)
Pro

| | | | | | | | | | | | | | | |
|---|---|---|---|---|---|---|---|---|---|---|---|---|---|---|
|Pro|Gly|Thr|Cys|Gly|Glu|Ile|Cys|Ala|Tyr|Ala|Xaa'|Ala|Cys|Thr|Xaa'|Gly|Cys|Xaa'|Xaa'|(SEQ ID NO: 4629)
|Pro|Gly|Thr|Cys|Gly|Glu|Ile|Cys|Ala|Tyr|Ala|Xaa'|Ala|Cys|Thr|Gly|Xaa'|Cys|(SEQ ID NO: 4630)
|Pro|Gly|Thr|Cys|Gly|Glu|Ile|Cys|Ala|Tyr|Ala|Xaa'|Ala|Cys|Thr|Gly|Xaa'|Xaa'|Cys|(SEQ ID NO: 4631)
|Pro|Gly|Thr|Cys|Gly|Glu|Ile|Cys|Ala|Tyr|Ala|Xaa'|Ala|Cys|Thr|Gly|Xaa'|Xaa'|Xaa'|Cys|(SEQ ID NO: 4632)
|Pro|Gly|Thr|Cys|Gly|Glu|Ile|Cys|Ala|Tyr|Ala|Xaa'|Ala|Cys|Thr|Gly|Xaa'|Xaa'|Xaa'|Xaa'|Cys|(SEQ ID NO: 4633)
|Pro|Gly|Thr|Cys|Gly|Glu|Ile|Cys|Ala|Tyr|Ala|Xaa'|Ala|Cys|Thr|Gly|Xaa'|Xaa'|Cys|Xaa'|(SEQ ID NO: 4634)
|Pro|Gly|Thr|Cys|Gly|Glu|Ile|Cys|Ala|Tyr|Ala|Xaa'|Ala|Cys|Thr|Gly|Xaa'|Xaa'|Cys|Xaa'|Xaa'|(SEQ ID NO: 4635)
|Pro|Gly|Thr|Cys|Gly|Glu|Ile|Cys|Ala|Tyr|Ala|Xaa'|Ala|Cys|Thr|Gly|Cys|Xaa'|(SEQ ID NO: 4636)
|Pro|Gly|Thr|Cys|Gly|Glu|Ile|Cys|Ala|Tyr|Ala|Xaa'|Ala|Cys|Thr|Gly|Cys|Xaa'|Xaa'|(SEQ ID NO: 4637)
|Pro|Gly|Thr|Cys|Gly|Glu|Ile|Cys|Ala|Tyr|Ala|Xaa'|Ala|Cys|Thr|Gly|Cys|Xaa'|Xaa'|Xaa'|(SEQ ID NO: 4638)
|Pro|Gly|Thr|Cys|Gly|Glu|Ile|Cys|Ala|Tyr|Ala|Xaa'|Ala|Ala|Xaa'|Cys|Thr|Gly|Cys|(SEQ ID NO: 4639)
|Pro|Gly|Thr|Cys|Gly|Glu|Ile|Cys|Ala|Tyr|Ala|Xaa'|Ala|Ala|Xaa'|Xaa'|Cys|Thr|Gly|Cys|(SEQ ID NO: 4640)
|Pro|Gly|Thr|Cys|Gly|Glu|Ile|Cys|Ala|Tyr|Ala|Xaa'|Ala|Ala|Xaa'|Xaa'|Xaa'|Cys|Thr|Gly|Cys|(SEQ ID NO: 4641)
|Pro|Gly|Thr|Cys|Gly|Glu|Ile|Cys|Ala|Tyr|Ala|Xaa'|Ala|Ala|Xaa'|Xaa'|Xaa'|Xaa'|Cys|Thr|Gly|Cys|(SEQ ID NO: 4642)
|Pro|Gly|Thr|Cys|Gly|Glu|Ile|Cys|Ala|Tyr|Ala|Xaa'|Ala|Ala|Xaa'|Xaa'|Xaa'|Xaa'|Cys|Xaa'|Thr|Gly|Cys|(SEQ ID NO: 4643)
|Pro|Gly|Thr|Cys|Gly|Glu|Ile|Cys|Ala|Tyr|Ala|Xaa'|Ala|Ala|Xaa'|Xaa'|Xaa'|Xaa'|Cys|Thr|Xaa'|Gly|Cys|(SEQ ID NO: 4644)
|Pro|Gly|Thr|Cys|Gly|Glu|Ile|Cys|Ala|Tyr|Ala|Xaa'|Ala|Ala|Xaa'|Xaa'|Xaa'|Xaa'|Cys|Thr|Xaa'|Gly|Cys|(SEQ ID NO: 4645)
|Pro|Gly|Thr|Cys|Gly|Glu|Ile|Cys|Ala|Tyr|Ala|Xaa'|Ala|Ala|Xaa'|Xaa'|Xaa'|Xaa'|Cys|Thr|Gly|Xaa'|Cys|(SEQ ID NO: 4646)
|Pro|Gly|Thr|Cys|Gly|Glu|Ile|Cys|Ala|Tyr|Ala|Xaa'|Ala|Ala|Xaa'|Xaa'|Xaa'|Xaa'|Cys|Thr|Gly|Cys|Xaa'|(SEQ ID NO: 4647)
|Pro|Gly|Thr|Cys|Gly|Glu|Ile|Cys|Ala|Tyr|Ala|Xaa'|Ala|Ala|Xaa'|Xaa'|Cys|Xaa'|Thr|Gly|Cys|(SEQ ID NO: 4648)
|Pro|Gly|Thr|Cys|Gly|Glu|Ile|Cys|Ala|Tyr|Ala|Xaa'|Ala|Ala|Xaa'|Xaa'|Cys|Xaa'|Xaa'|Thr|Gly|Cys|(SEQ ID NO: 4649)
|Pro|Gly|Thr|Cys|Gly|Glu|Ile|Cys|Ala|Tyr|Ala|Xaa'|Ala|Ala|Xaa'|Xaa'|Cys|Xaa'|Xaa'|Xaa'|Thr|Gly|Cys|(SEQ ID NO: 4650)
|Pro|Gly|Thr|Cys|Gly|Glu|Ile|Cys|Ala|Tyr|Ala|Xaa'|Ala|Ala|Xaa'|Xaa'|Cys|Xaa'|Thr|Gly|Xaa'|Cys|(SEQ ID NO: 4651)
|Pro|Gly|Thr|Cys|Gly|Glu|Ile|Cys|Ala|Tyr|Ala|Xaa'|Ala|Ala|Xaa'|Xaa'|Cys|Xaa'|Thr|Gly|Cys|(SEQ ID NO: 4652)
|Pro|Gly|Thr|Cys|Gly|Glu|Ile|Cys|Ala|Tyr|Ala|Xaa'|Ala|Ala|Xaa'|Xaa'|Cys|Xaa'|Thr|Gly|Xaa'|Cys|Xaa'|(SEQ ID NO: 4653)
|Pro|Gly|Thr|Cys|Gly|Glu|Ile|Cys|Ala|Tyr|Ala|Xaa'|Ala|Ala|Xaa'|Xaa'|Cys|Xaa'|Thr|Gly|Cys|Xaa'|(SEQ ID NO: 4654)
|Pro|Gly|Thr|Cys|Gly|Glu|Ile|Cys|Ala|Tyr|Ala|Xaa'|Ala|Ala|Xaa'|Xaa'|Cys|Xaa'|Thr|Gly|Cys|Xaa'|Xaa'|(SEQ ID NO: 4655)
|Pro|Gly|Thr|Cys|Gly|Glu|Ile|Cys|Ala|Tyr|Ala|Xaa'|Ala|Ala|Xaa'|Xaa'|Cys|Thr|Gly|Xaa'|Cys|(SEQ ID NO: 4656)
|Pro|Gly|Thr|Cys|Gly|Glu|Ile|Cys|Ala|Tyr|Ala|Xaa'|Ala|Ala|Xaa'|Xaa'|Cys|Thr|Gly|Xaa'|Xaa'|Cys|(SEQ ID NO: 4657)
|Pro|Gly|Thr|Cys|Gly|Glu|Ile|Cys|Ala|Tyr|Ala|Xaa'|Ala|Ala|Xaa'|Xaa'|Cys|Thr|Gly|Xaa'|Cys|Xaa'|(SEQ ID NO: 4658)
|Pro|Gly|Thr|Cys|Gly|Glu|Ile|Cys|Ala|Tyr|Ala|Xaa'|Ala|Ala|Xaa'|Xaa'|Cys|Thr|Gly|Cys|Xaa'|(SEQ ID NO: 4659)
|Pro|Gly|Thr|Cys|Gly|Glu|Ile|Cys|Ala|Tyr|Ala|Xaa'|Ala|Ala|Xaa'|Xaa'|Cys|Thr|Gly|Cys|Xaa'|Xaa'|(SEQ ID NO: 4660)
|Pro|Gly|Thr|Cys|Gly|Glu|Ile|Cys|Ala|Tyr|Ala|Xaa'|Ala|Ala|Cys|Xaa'|Thr|Gly|Cys|(SEQ ID NO: 4661)
|Pro|Gly|Thr|Cys|Gly|Glu|Ile|Cys|Ala|Tyr|Ala|Ala|Xaa'|Cys|Xaa'|Xaa'|Thr|Gly|Cys|(SEQ ID NO: 4662)

FIG. 2

| | | | | | | | | | | | | |
|---|---|---|---|---|---|---|---|---|---|---|---|---|
| Pro | Gly | Thr | Cys | Gly | Glu | Ile | Cys | Ala | Tyr | Ala | Ala | Xaa | Cys | Xaa' | Xaa' | Xaa' | Thr | Gly | Cys | (SEQ ID NO: 4663) |
| Pro | Gly | Thr | Cys | Gly | Glu | Ile | Cys | Ala | Tyr | Ala | Ala | Xaa | Cys | Xaa' | Xaa' | Thr | Xaa' | Gly | Cys | (SEQ ID NO: 4664) |
| Pro | Gly | Thr | Cys | Gly | Glu | Ile | Cys | Ala | Tyr | Ala | Ala | Xaa | Cys | Xaa' | Xaa' | Thr | Gly | Xaa' | Cys | (SEQ ID NO: 4665) |
| Pro | Gly | Thr | Cys | Gly | Glu | Ile | Cys | Ala | Tyr | Ala | Ala | Xaa | Cys | Xaa' | Xaa' | Thr | Gly | Cys | Xaa' | (SEQ ID NO: 4666) |
| Pro | Gly | Thr | Cys | Gly | Glu | Ile | Cys | Ala | Tyr | Ala | Ala | Xaa | Cys | Xaa' | Thr | Xaa' | Xaa' | Gly | Cys | (SEQ ID NO: 4667) |
| Pro | Gly | Thr | Cys | Gly | Glu | Ile | Cys | Ala | Tyr | Ala | Ala | Xaa | Cys | Xaa' | Thr | Xaa' | Gly | Xaa' | Cys | (SEQ ID NO: 4668) |
| Pro | Gly | Thr | Cys | Gly | Glu | Ile | Cys | Ala | Tyr | Ala | Ala | Xaa | Cys | Xaa' | Thr | Xaa' | Gly | Cys | Xaa' | (SEQ ID NO: 4669) |
| Pro | Gly | Thr | Cys | Gly | Glu | Ile | Cys | Ala | Tyr | Ala | Ala | Xaa | Cys | Xaa' | Thr | Gly | Xaa' | Xaa' | Cys | (SEQ ID NO: 4670) |
| Pro | Gly | Thr | Cys | Gly | Glu | Ile | Cys | Ala | Tyr | Ala | Ala | Xaa | Cys | Xaa' | Thr | Gly | Xaa' | Cys | Xaa' | (SEQ ID NO: 4671) |
| Pro | Gly | Thr | Cys | Gly | Glu | Ile | Cys | Ala | Tyr | Ala | Ala | Xaa | Cys | Xaa' | Thr | Gly | Cys | Xaa' | Xaa' | (SEQ ID NO: 4672) |
| Pro | Gly | Thr | Cys | Gly | Glu | Ile | Cys | Ala | Tyr | Ala | Ala | Xaa | Cys | Thr | Xaa' | Xaa' | Xaa' | Gly | Cys | (SEQ ID NO: 4673) |
| Pro | Gly | Thr | Cys | Gly | Glu | Ile | Cys | Ala | Tyr | Ala | Ala | Xaa | Cys | Thr | Xaa' | Xaa' | Gly | Xaa' | Cys | (SEQ ID NO: 4674) |
| Pro | Gly | Thr | Cys | Gly | Glu | Ile | Cys | Ala | Tyr | Ala | Ala | Xaa | Cys | Thr | Xaa' | Xaa' | Gly | Cys | Xaa' | (SEQ ID NO: 4675) |
| Pro | Gly | Thr | Cys | Gly | Glu | Ile | Cys | Ala | Tyr | Ala | Ala | Xaa | Cys | Thr | Xaa' | Gly | Xaa' | Xaa' | Cys | (SEQ ID NO: 4676) |
| Pro | Gly | Thr | Cys | Gly | Glu | Ile | Cys | Ala | Tyr | Ala | Ala | Xaa | Cys | Thr | Xaa' | Gly | Xaa' | Cys | Xaa' | (SEQ ID NO: 4677) |
| Pro | Gly | Thr | Cys | Gly | Glu | Ile | Cys | Ala | Tyr | Ala | Ala | Xaa | Cys | Thr | Xaa' | Gly | Cys | Xaa' | Xaa' | (SEQ ID NO: 4678) |
| Pro | Gly | Thr | Cys | Gly | Glu | Ile | Cys | Ala | Tyr | Ala | Ala | Xaa | Cys | Thr | Gly | Xaa' | Xaa' | Xaa' | Cys | (SEQ ID NO: 4679) |
| Pro | Gly | Thr | Cys | Gly | Glu | Ile | Cys | Ala | Tyr | Ala | Ala | Xaa | Cys | Thr | Gly | Xaa' | Xaa' | Cys | Xaa' | (SEQ ID NO: 4680) |
| Pro | Gly | Thr | Cys | Gly | Glu | Ile | Cys | Ala | Tyr | Ala | Ala | Xaa | Cys | Thr | Gly | Xaa' | Cys | Xaa' | Xaa' | (SEQ ID NO: 4681) |
| Pro | Gly | Thr | Cys | Gly | Glu | Ile | Cys | Ala | Tyr | Ala | Ala | Xaa | Cys | Thr | Gly | Cys | Xaa' | Xaa' | Xaa' | (SEQ ID NO: 4682) |
| Pro | Gly | Thr | Cys | Gly | Glu | Ile | Cys | Ala | Tyr | Ala | Ala | Cys | Xaa' | Xaa' | Xaa' | Xaa' | Thr | Gly | Cys | (SEQ ID NO: 4683) |
| Pro | Gly | Thr | Cys | Gly | Glu | Ile | Cys | Ala | Tyr | Ala | Ala | Cys | Xaa' | Xaa' | Xaa' | Thr | Xaa' | Gly | Cys | (SEQ ID NO: 4684) |
| Pro | Gly | Thr | Cys | Gly | Glu | Ile | Cys | Ala | Tyr | Ala | Ala | Cys | Xaa' | Xaa' | Xaa' | Thr | Gly | Cys | Xaa' | (SEQ ID NO: 4685) |
| Pro | Gly | Thr | Cys | Gly | Glu | Ile | Cys | Ala | Tyr | Ala | Ala | Cys | Xaa' | Xaa' | Xaa' | Thr | Gly | Xaa' | Cys | (SEQ ID NO: 4686) |
| Pro | Gly | Thr | Cys | Gly | Glu | Ile | Cys | Ala | Tyr | Ala | Ala | Cys | Xaa' | Xaa' | Thr | Xaa' | Xaa' | Gly | Cys | (SEQ ID NO: 4687) |
| Pro | Gly | Thr | Cys | Gly | Glu | Ile | Cys | Ala | Tyr | Ala | Ala | Cys | Xaa' | Xaa' | Thr | Xaa' | Gly | Xaa' | Cys | (SEQ ID NO: 4688) |
| Pro | Gly | Thr | Cys | Gly | Glu | Ile | Cys | Ala | Tyr | Ala | Ala | Cys | Xaa' | Xaa' | Thr | Xaa' | Gly | Cys | Xaa' | (SEQ ID NO: 4689) |
| Pro | Gly | Thr | Cys | Gly | Glu | Ile | Cys | Ala | Tyr | Ala | Ala | Cys | Xaa' | Xaa' | Thr | Gly | Xaa' | Xaa' | Cys | (SEQ ID NO: 4690) |
| Pro | Gly | Thr | Cys | Gly | Glu | Ile | Cys | Ala | Tyr | Ala | Ala | Cys | Xaa' | Xaa' | Thr | Gly | Xaa' | Cys | Xaa' | (SEQ ID NO: 4691) |
| Pro | Gly | Thr | Cys | Gly | Glu | Ile | Cys | Ala | Tyr | Ala | Ala | Cys | Xaa' | Xaa' | Thr | Gly | Cys | Xaa' | Xaa' | (SEQ ID NO: 4692) |
| Pro | Gly | Thr | Cys | Gly | Glu | Ile | Cys | Ala | Tyr | Ala | Ala | Cys | Xaa' | Thr | Xaa' | Xaa' | Gly | Cys | Xaa' | (SEQ ID NO: 4693) |
| Pro | Gly | Thr | Cys | Gly | Glu | Ile | Cys | Ala | Tyr | Ala | Ala | Cys | Xaa' | Thr | Xaa' | Gly | Cys | Xaa' | Xaa' | (SEQ ID NO: 4694) |
| Pro | Gly | Thr | Cys | Gly | Glu | Ile | Cys | Ala | Tyr | Ala | Ala | Cys | Xaa' | Thr | Gly | Cys | Xaa' | Xaa' | Xaa' | (SEQ ID NO: 4695) |
| Pro | Gly | Thr | Cys | Gly | Glu | Ile | Cys | Ala | Tyr | Ala | Ala | Cys | Xaa' | Xaa' | Cys | Xaa' | Thr | Gly | Cys | (SEQ ID NO: 4696) |

FIG. 2

| | |
|---|---|
| Pro Gly Thr Cys Gly Glu Ile Cys Ala Tyr Ala Ala Cys Xaa' Xaa' Xaa' Thr Gly Cys | (SEQ ID NO: 4697) |
| Pro Gly Thr Cys Gly Glu Ile Cys Ala Tyr Ala Ala Cys Xaa' Xaa' Xaa' Thr Gly Cys | (SEQ ID NO: 4698) |
| Pro Gly Thr Cys Gly Glu Ile Cys Ala Tyr Ala Ala Cys Xaa' Xaa' Xaa' Thr Xaa' Gly Cys | (SEQ ID NO: 4699) |
| Pro Gly Thr Cys Gly Glu Ile Cys Ala Tyr Ala Ala Cys Xaa' Xaa' Xaa' Xaa' Thr Gly Xaa' Cys | (SEQ ID NO: 4700) |
| Pro Gly Thr Cys Gly Glu Ile Cys Ala Tyr Ala Ala Cys Xaa' Xaa' Xaa' Xaa' Thr Gly Cys Xaa' | (SEQ ID NO: 4701) |
| Pro Gly Thr Cys Gly Glu Ile Cys Ala Tyr Ala Ala Cys Xaa' Xaa' Xaa' Thr Xaa' Gly Cys | (SEQ ID NO: 4702) |
| Pro Gly Thr Cys Gly Glu Ile Cys Ala Tyr Ala Ala Cys Xaa' Xaa' Xaa' Thr Xaa' Gly Xaa' Cys | (SEQ ID NO: 4703) |
| Pro Gly Thr Cys Gly Glu Ile Cys Ala Tyr Ala Ala Cys Xaa' Xaa' Xaa' Thr Xaa' Gly Xaa' Cys | (SEQ ID NO: 4704) |
| Pro Gly Thr Cys Gly Glu Ile Cys Ala Tyr Ala Ala Cys Xaa' Xaa' Xaa' Thr Xaa' Gly Cys Xaa' | (SEQ ID NO: 4705) |
| Pro Gly Thr Cys Gly Glu Ile Cys Ala Tyr Ala Ala Cys Xaa' Xaa' Xaa' Thr Gly Xaa' Cys | (SEQ ID NO: 4706) |
| Pro Gly Thr Cys Gly Glu Ile Cys Ala Tyr Ala Ala Cys Xaa' Xaa' Xaa' Thr Gly Xaa' Xaa' Cys | (SEQ ID NO: 4707) |
| Pro Gly Thr Cys Gly Glu Ile Cys Ala Tyr Ala Ala Cys Xaa' Xaa' Xaa' Thr Gly Xaa' Cys Xaa' | (SEQ ID NO: 4708) |
| Pro Gly Thr Cys Gly Glu Ile Cys Ala Tyr Ala Ala Cys Xaa' Xaa' Xaa' Thr Gly Cys Xaa' | (SEQ ID NO: 4709) |
| Pro Gly Thr Cys Gly Glu Ile Cys Ala Tyr Ala Ala Cys Xaa' Xaa' Xaa' Thr Gly Cys Xaa' | (SEQ ID NO: 4710) |
| Pro Gly Thr Cys Gly Glu Ile Cys Ala Tyr Ala Ala Cys Xaa' Xaa' Thr Xaa' Gly Cys | (SEQ ID NO: 4711) |
| Pro Gly Thr Cys Gly Glu Ile Cys Ala Tyr Ala Ala Cys Xaa' Xaa' Thr Xaa' Xaa' Gly Cys | (SEQ ID NO: 4712) |
| Pro Gly Thr Cys Gly Glu Ile Cys Ala Tyr Ala Ala Cys Xaa' Xaa' Thr Xaa' Xaa' Gly Xaa' Cys | (SEQ ID NO: 4713) |
| Pro Gly Thr Cys Gly Glu Ile Cys Ala Tyr Ala Ala Cys Xaa' Xaa' Thr Xaa' Xaa' Gly Xaa' Cys | (SEQ ID NO: 4714) |
| Pro Gly Thr Cys Gly Glu Ile Cys Ala Tyr Ala Ala Cys Xaa' Xaa' Thr Xaa' Xaa' Gly Cys Xaa' | (SEQ ID NO: 4715) |
| Pro Gly Thr Cys Gly Glu Ile Cys Ala Tyr Ala Ala Cys Xaa' Xaa' Thr Xaa' Gly Xaa' Cys | (SEQ ID NO: 4716) |
| Pro Gly Thr Cys Gly Glu Ile Cys Ala Tyr Ala Ala Cys Xaa' Xaa' Thr Xaa' Gly Xaa' Xaa' Cys | (SEQ ID NO: 4717) |
| Pro Gly Thr Cys Gly Glu Ile Cys Ala Tyr Ala Ala Cys Xaa' Xaa' Thr Xaa' Gly Xaa' Cys Xaa' | (SEQ ID NO: 4718) |
| Pro Gly Thr Cys Gly Glu Ile Cys Ala Tyr Ala Ala Cys Xaa' Xaa' Thr Xaa' Gly Cys Xaa' | (SEQ ID NO: 4719) |
| Pro Gly Thr Cys Gly Glu Ile Cys Ala Tyr Ala Ala Cys Xaa' Xaa' Thr Xaa' Gly Cys Xaa' | (SEQ ID NO: 4720) |
| Pro Gly Thr Cys Gly Glu Ile Cys Ala Tyr Ala Ala Cys Xaa' Xaa' Thr Gly Xaa' Xaa' Cys | (SEQ ID NO: 4721) |
| Pro Gly Thr Cys Gly Glu Ile Cys Ala Tyr Ala Ala Cys Xaa' Xaa' Thr Gly Xaa' Xaa' Xaa' Cys | (SEQ ID NO: 4722) |
| Pro Gly Thr Cys Gly Glu Ile Cys Ala Tyr Ala Ala Cys Xaa' Xaa' Thr Gly Xaa' Xaa' Cys Xaa' | (SEQ ID NO: 4723) |
| Pro Gly Thr Cys Gly Glu Ile Cys Ala Tyr Ala Ala Cys Xaa' Xaa' Thr Gly Xaa' Cys Xaa' | (SEQ ID NO: 4724) |
| Pro Gly Thr Cys Gly Glu Ile Cys Ala Tyr Ala Ala Cys Xaa' Xaa' Thr Gly Xaa' Cys Xaa' | (SEQ ID NO: 4725) |
| Pro Gly Thr Cys Gly Glu Ile Cys Ala Tyr Ala Ala Cys Xaa' Xaa' Thr Gly Xaa' Cys Xaa' Xaa' | (SEQ ID NO: 4726) |
| Pro Gly Thr Cys Gly Glu Ile Cys Ala Tyr Ala Ala Cys Xaa' Xaa' Thr Gly Cys Xaa' Xaa' | (SEQ ID NO: 4727) |
| Pro Gly Thr Cys Gly Glu Ile Cys Ala Tyr Ala Ala Cys Xaa' Thr Gly Cys Xaa' Xaa' | (SEQ ID NO: 4728) |
| Pro Gly Thr Cys Gly Glu Ile Cys Ala Tyr Ala Ala Cys Xaa' Thr Gly Cys Xaa' Xaa' | (SEQ ID NO: 4729) |
| Pro Gly Thr Cys Gly Glu Ile Cys Ala Tyr Ala Ala Cys Xaa' Thr Xaa' Ala Cys Thr Xaa' Gly Cys | (SEQ ID NO: 4730) |

FIG. 2

| | | | | | | | | | | | | |
|---|---|---|---|---|---|---|---|---|---|---|---|---|
| Pro | Gly | Thr | Cys | Gly | Glu | Ile | Cys | Ala | Tyr | Ala | Ala | Cys | Thr | Xaa' | Xaa' | Gly | Cys | | | | (SEQID NO: 4731) |
| Pro | Gly | Thr | Cys | Gly | Glu | Ile | Cys | Ala | Tyr | Ala | Ala | Cys | Thr | Xaa' | Xaa' | Xaa' | Gly | Cys | | | (SEQID NO: 4732) |
| Pro | Gly | Thr | Cys | Gly | Glu | Ile | Cys | Ala | Tyr | Ala | Ala | Cys | Thr | Xaa' | Xaa' | Xaa' | Xaa' | Gly | Cys | | (SEQID NO: 4733) |
| Pro | Gly | Thr | Cys | Gly | Glu | Ile | Cys | Ala | Tyr | Ala | Ala | Cys | Thr | Xaa' | Xaa' | Xaa' | Xaa' | Gly | Xaa' | Cys | (SEQID NO: 4734) |
| Pro | Gly | Thr | Cys | Gly | Glu | Ile | Cys | Ala | Tyr | Ala | Ala | Cys | Thr | Xaa' | Xaa' | Xaa' | Xaa' | Gly | Cys | Xaa' | (SEQID NO: 4735) |
| Pro | Gly | Thr | Cys | Gly | Glu | Ile | Cys | Ala | Tyr | Ala | Ala | Cys | Thr | Xaa' | Xaa' | Xaa' | Gly | Xaa' | Cys | | (SEQID NO: 4736) |
| Pro | Gly | Thr | Cys | Gly | Glu | Ile | Cys | Ala | Tyr | Ala | Ala | Cys | Thr | Xaa' | Xaa' | Xaa' | Gly | Xaa' | Xaa' | Cys | (SEQID NO: 4737) |
| Pro | Gly | Thr | Cys | Gly | Glu | Ile | Cys | Ala | Tyr | Ala | Ala | Cys | Thr | Xaa' | Xaa' | Xaa' | Gly | Xaa' | Cys | Xaa' | (SEQID NO: 4738) |
| Pro | Gly | Thr | Cys | Gly | Glu | Ile | Cys | Ala | Tyr | Ala | Ala | Cys | Thr | Xaa' | Xaa' | Xaa' | Gly | Cys | Xaa' | | (SEQID NO: 4739) |
| Pro | Gly | Thr | Cys | Gly | Glu | Ile | Cys | Ala | Tyr | Ala | Ala | Cys | Thr | Xaa' | Xaa' | Xaa' | Gly | Cys | Xaa' | Xaa' | (SEQID NO: 4740) |
| Pro | Gly | Thr | Cys | Gly | Glu | Ile | Cys | Ala | Tyr | Ala | Ala | Cys | Thr | Xaa' | Xaa' | Gly | Xaa' | Cys | | | (SEQID NO: 4741) |
| Pro | Gly | Thr | Cys | Gly | Glu | Ile | Cys | Ala | Tyr | Ala | Ala | Cys | Thr | Xaa' | Xaa' | Gly | Xaa' | Xaa' | Cys | | (SEQID NO: 4742) |
| Pro | Gly | Thr | Cys | Gly | Glu | Ile | Cys | Ala | Tyr | Ala | Ala | Cys | Thr | Xaa' | Xaa' | Gly | Xaa' | Xaa' | Xaa' | Cys | (SEQID NO: 4743) |
| Pro | Gly | Thr | Cys | Gly | Glu | Ile | Cys | Ala | Tyr | Ala | Ala | Cys | Thr | Xaa' | Xaa' | Gly | Xaa' | Xaa' | Cys | Xaa' | (SEQID NO: 4744) |
| Pro | Gly | Thr | Cys | Gly | Glu | Ile | Cys | Ala | Tyr | Ala | Ala | Cys | Thr | Xaa' | Xaa' | Gly | Xaa' | Cys | Xaa' | | (SEQID NO: 4745) |
| Pro | Gly | Thr | Cys | Gly | Glu | Ile | Cys | Ala | Tyr | Ala | Ala | Cys | Thr | Xaa' | Xaa' | Gly | Xaa' | Cys | Xaa' | Xaa' | (SEQID NO: 4746) |
| Pro | Gly | Thr | Cys | Gly | Glu | Ile | Cys | Ala | Tyr | Ala | Ala | Cys | Thr | Xaa' | Xaa' | Gly | Cys | Xaa' | | | (SEQID NO: 4747) |
| Pro | Gly | Thr | Cys | Gly | Glu | Ile | Cys | Ala | Tyr | Ala | Ala | Cys | Thr | Xaa' | Xaa' | Gly | Cys | Xaa' | Xaa' | | (SEQID NO: 4748) |
| Pro | Gly | Thr | Cys | Gly | Glu | Ile | Cys | Ala | Tyr | Ala | Ala | Cys | Thr | Xaa' | Xaa' | Gly | Cys | Xaa' | Xaa' | Xaa' | (SEQID NO: 4749) |
| Pro | Gly | Thr | Cys | Gly | Glu | Ile | Cys | Ala | Tyr | Ala | Ala | Cys | Thr | Xaa' | Gly | Xaa' | Cys | | | | (SEQID NO: 4750) |
| Pro | Gly | Thr | Cys | Gly | Glu | Ile | Cys | Ala | Tyr | Ala | Ala | Cys | Thr | Xaa' | Gly | Xaa' | Xaa' | Cys | | | (SEQID NO: 4751) |
| Pro | Gly | Thr | Cys | Gly | Glu | Ile | Cys | Ala | Tyr | Ala | Ala | Cys | Thr | Xaa' | Gly | Xaa' | Xaa' | Xaa' | Cys | | (SEQID NO: 4752) |
| Pro | Gly | Thr | Cys | Gly | Glu | Ile | Cys | Ala | Tyr | Ala | Ala | Cys | Thr | Xaa' | Gly | Xaa' | Xaa' | Xaa' | Xaa' | Cys | (SEQID NO: 4753) |
| Pro | Gly | Thr | Cys | Gly | Glu | Ile | Cys | Ala | Tyr | Ala | Ala | Cys | Thr | Xaa' | Gly | Xaa' | Xaa' | Xaa' | Cys | Xaa' | (SEQID NO: 4754) |
| Pro | Gly | Thr | Cys | Gly | Glu | Ile | Cys | Ala | Tyr | Ala | Ala | Cys | Thr | Xaa' | Gly | Xaa' | Xaa' | Cys | Xaa' | | (SEQID NO: 4755) |
| Pro | Gly | Thr | Cys | Gly | Glu | Ile | Cys | Ala | Tyr | Ala | Ala | Cys | Thr | Xaa' | Gly | Xaa' | Xaa' | Cys | Xaa' | Xaa' | (SEQID NO: 4756) |
| Pro | Gly | Thr | Cys | Gly | Glu | Ile | Cys | Ala | Tyr | Ala | Ala | Cys | Thr | Xaa' | Gly | Xaa' | Cys | Xaa' | | | (SEQID NO: 4757) |
| Pro | Gly | Thr | Cys | Gly | Glu | Ile | Cys | Ala | Tyr | Ala | Ala | Cys | Thr | Xaa' | Gly | Xaa' | Cys | Xaa' | Xaa' | | (SEQID NO: 4758) |
| Pro | Gly | Thr | Cys | Gly | Glu | Ile | Cys | Ala | Tyr | Ala | Ala | Cys | Thr | Xaa' | Gly | Xaa' | Cys | Xaa' | Xaa' | Xaa' | (SEQID NO: 4759) |
| Pro | Gly | Thr | Cys | Gly | Glu | Ile | Cys | Ala | Tyr | Ala | Ala | Cys | Thr | Gly | Cys | Xaa' | Xaa' | | | | (SEQID NO: 4760) |
| Pro | Gly | Thr | Cys | Gly | Glu | Ile | Cys | Ala | Tyr | Ala | Ala | Cys | Thr | Gly | Cys | Xaa' | Xaa' | Xaa' | | | (SEQID NO: 4761) |
| Pro | Gly | Thr | Cys | Gly | Glu | Ile | Cys | Ala | Tyr | Ala | Ala | Cys | Thr | Gly | Cys | Xaa' | Xaa' | Xaa' | Xaa' | | (SEQID NO: 4762) |
| Pro | Gly | Thr | Cys | Gly | Glu | Ile | Cys | Ala | Tyr | Ala | Ala | Cys | Thr | Gly | Cys | Xaa' | Xaa' | Xaa' | Xaa' | Xaa' | (SEQID NO: 4763) |

FIG. 2

(SEQ ID NO: 4764) Cys Glu Tyr Cys Ala Asn Pro Ala Cys Thr Gly Cys Tyr
(SEQ ID NO: 4765) Cys Glu Tyr Cys Ala Asn Pro Ala Cys Thr Ala Cys Tyr
(SEQ ID NO: 4766) Cys Glu Tyr Cys Ala Asn Pro Ala Cys Val Gly Cys Tyr
(SEQ ID NO: 4767) Cys Glu Tyr Cys Ala Asn Pro Ala Cys Val Ala Cys Tyr
(SEQ ID NO: 4768) Cys Glu Tyr Cys Ala Asn Pro Ala Cys Gly Gly Cys Tyr
(SEQ ID NO: 4769) Cys Glu Tyr Cys Ala Asn Pro Ala Cys Gly Ala Cys Tyr
(SEQ ID NO: 4770) Cys Glu Tyr Cys Ala Asn Pro Thr Cys Thr Gly Cys Tyr
(SEQ ID NO: 4771) Cys Glu Tyr Cys Ala Asn Pro Thr Cys Thr Ala Cys Tyr
(SEQ ID NO: 4772) Cys Glu Tyr Cys Ala Asn Pro Thr Cys Val Gly Cys Tyr
(SEQ ID NO: 4773) Cys Glu Tyr Cys Ala Asn Pro Thr Cys Val Ala Cys Tyr
(SEQ ID NO: 4774) Cys Glu Tyr Cys Ala Asn Pro Thr Cys Gly Gly Cys Tyr
(SEQ ID NO: 4775) Cys Glu Tyr Cys Ala Asn Pro Thr Cys Gly Ala Cys Tyr
(SEQ ID NO: 4776) Cys Glu Tyr Cys Ala Asn Gly Ala Cys Thr Gly Cys Tyr
(SEQ ID NO: 4777) Cys Glu Tyr Cys Ala Asn Gly Ala Cys Thr Ala Cys Tyr
(SEQ ID NO: 4778) Cys Glu Tyr Cys Ala Asn Gly Ala Cys Val Gly Cys Tyr
(SEQ ID NO: 4779) Cys Glu Tyr Cys Ala Asn Gly Ala Cys Val Ala Cys Tyr
(SEQ ID NO: 4780) Cys Glu Tyr Cys Ala Asn Gly Ala Cys Gly Gly Cys Tyr
(SEQ ID NO: 4781) Cys Glu Tyr Cys Ala Asn Gly Ala Cys Gly Ala Cys Tyr
(SEQ ID NO: 4782) Cys Glu Tyr Cys Ala Asn Gly Thr Cys Thr Gly Cys Tyr
(SEQ ID NO: 4783) Cys Glu Tyr Cys Ala Asn Gly Thr Cys Thr Ala Cys Tyr
(SEQ ID NO: 4784) Cys Glu Tyr Cys Ala Asn Gly Thr Cys Val Gly Cys Tyr
(SEQ ID NO: 4785) Cys Glu Tyr Cys Ala Asn Gly Thr Cys Val Ala Cys Tyr
(SEQ ID NO: 4786) Cys Glu Tyr Cys Ala Asn Gly Thr Cys Gly Gly Cys Tyr
(SEQ ID NO: 4787) Cys Glu Tyr Cys Ala Asn Gly Thr Cys Gly Ala Cys Tyr
(SEQ ID NO: 4788) Cys Glu Tyr Cys Arg Asn Pro Ala Cys Thr Gly Cys Tyr
(SEQ ID NO: 4789) Cys Glu Tyr Cys Arg Asn Pro Ala Cys Thr Ala Cys Tyr
(SEQ ID NO: 4790) Cys Glu Tyr Cys Arg Asn Pro Ala Cys Val Gly Cys Tyr
(SEQ ID NO: 4791) Cys Glu Tyr Cys Arg Asn Pro Ala Cys Val Ala Cys Tyr
(SEQ ID NO: 4792) Cys Glu Tyr Cys Arg Asn Pro Ala Cys Gly Gly Cys Tyr
(SEQ ID NO: 4793) Cys Glu Tyr Cys Arg Asn Pro Ala Cys Gly Ala Cys Tyr
(SEQ ID NO: 4794) Cys Glu Tyr Cys Arg Asn Pro Thr Cys Thr Gly Cys Tyr
(SEQ ID NO: 4795) Cys Glu Tyr Cys Arg Asn Pro Thr Cys Thr Ala Cys Tyr
(SEQ ID NO: 4796) Cys Glu Tyr Cys Arg Asn Pro Thr Cys Val Gly Cys Tyr
(SEQ ID NO: 4797) Cys Glu Tyr Cys Arg Asn Pro Thr Cys Val Ala Cys Tyr
(SEQ ID NO: 4798) Cys Glu Tyr Cys Arg Asn Pro Thr Cys Gly Gly Cys Tyr
(SEQ ID NO: 4799) Cys Glu Tyr Cys Arg Asn Pro Thr Cys Gly Ala Cys Tyr
(SEQ ID NO: 4800) Cys Glu Tyr Cys Arg Asn Gly Ala Cys Thr Gly Cys Tyr
(SEQ ID NO: 4801) Cys Glu Tyr Cys Arg Asn Gly Ala Cys Thr Ala Cys Tyr
(SEQ ID NO: 4802) Cys Glu Tyr Cys Arg Asn Gly Ala Cys Val Gly Cys Tyr
(SEQ ID NO: 4803) Cys Glu Tyr Cys Arg Asn Gly Ala Cys Val Ala Cys Tyr
(SEQ ID NO: 4804) Cys Glu Tyr Cys Arg Asn Gly Ala Cys Gly Gly Cys Tyr
(SEQ ID NO: 4805) Cys Glu Tyr Cys Arg Asn Gly Ala Cys Gly Ala Cys Tyr
(SEQ ID NO: 4806) Cys Glu Tyr Cys Arg Asn Gly Thr Cys Thr Gly Cys Tyr

FIG. 3

(SEQ ID NO: 4807) Cys Glu Tyr Cys Arg Asn Gly Thr Cys Thr Ala Cys Tyr
(SEQ ID NO: 4808) Cys Glu Tyr Cys Arg Asn Gly Thr Cys Val Gly Cys Tyr
(SEQ ID NO: 4809) Cys Glu Tyr Cys Arg Asn Gly Thr Cys Val Ala Cys Tyr
(SEQ ID NO: 4810) Cys Glu Tyr Cys Arg Asn Gly Thr Cys Gly Gly Cys Tyr
(SEQ ID NO: 4811) Cys Glu Tyr Cys Arg Asn Gly Thr Cys Gly Ala Cys Tyr
(SEQ ID NO: 4812) Cys Glu Tyr Cys Asn Asn Pro Ala Cys Thr Gly Cys Tyr
(SEQ ID NO: 4813) Cys Glu Tyr Cys Asn Asn Pro Ala Cys Thr Ala Cys Tyr
(SEQ ID NO: 4814) Cys Glu Tyr Cys Asn Asn Pro Ala Cys Val Gly Cys Tyr
(SEQ ID NO: 4815) Cys Glu Tyr Cys Asn Asn Pro Ala Cys Val Ala Cys Tyr
(SEQ ID NO: 4816) Cys Glu Tyr Cys Asn Asn Pro Ala Cys Gly Gly Cys Tyr
(SEQ ID NO: 4817) Cys Glu Tyr Cys Asn Asn Pro Ala Cys Gly Ala Cys Tyr
(SEQ ID NO: 4818) Cys Glu Tyr Cys Asn Asn Pro Thr Cys Thr Gly Cys Tyr
(SEQ ID NO: 4819) Cys Glu Tyr Cys Asn Asn Pro Thr Cys Thr Ala Cys Tyr
(SEQ ID NO: 4820) Cys Glu Tyr Cys Asn Asn Pro Thr Cys Val Gly Cys Tyr
(SEQ ID NO: 4821) Cys Glu Tyr Cys Asn Asn Pro Thr Cys Val Ala Cys Tyr
(SEQ ID NO: 4822) Cys Glu Tyr Cys Asn Asn Pro Thr Cys Gly Gly Cys Tyr
(SEQ ID NO: 4823) Cys Glu Tyr Cys Asn Asn Pro Thr Cys Gly Ala Cys Tyr
(SEQ ID NO: 4824) Cys Glu Tyr Cys Asn Asn Gly Ala Cys Thr Gly Cys Tyr
(SEQ ID NO: 4825) Cys Glu Tyr Cys Asn Asn Gly Ala Cys Thr Ala Cys Tyr
(SEQ ID NO: 4826) Cys Glu Tyr Cys Asn Asn Gly Ala Cys Val Gly Cys Tyr
(SEQ ID NO: 4827) Cys Glu Tyr Cys Asn Asn Gly Ala Cys Val Ala Cys Tyr
(SEQ ID NO: 4828) Cys Glu Tyr Cys Asn Asn Gly Ala Cys Gly Gly Cys Tyr
(SEQ ID NO: 4829) Cys Glu Tyr Cys Asn Asn Gly Ala Cys Gly Ala Cys Tyr
(SEQ ID NO: 4830) Cys Glu Tyr Cys Asn Asn Gly Thr Cys Thr Gly Cys Tyr
(SEQ ID NO: 4831) Cys Glu Tyr Cys Asn Asn Gly Thr Cys Thr Ala Cys Tyr
(SEQ ID NO: 4832) Cys Glu Tyr Cys Asn Asn Gly Thr Cys Val Gly Cys Tyr
(SEQ ID NO: 4833) Cys Glu Tyr Cys Asn Asn Gly Thr Cys Val Ala Cys Tyr
(SEQ ID NO: 4834) Cys Glu Tyr Cys Asn Asn Gly Thr Cys Gly Gly Cys Tyr
(SEQ ID NO: 4835) Cys Glu Tyr Cys Asn Asn Gly Thr Cys Gly Ala Cys Tyr
(SEQ ID NO: 4836) Cys Glu Tyr Cys Asp Asn Pro Ala Cys Thr Gly Cys Tyr
(SEQ ID NO: 4837) Cys Glu Tyr Cys Asp Asn Pro Ala Cys Thr Ala Cys Tyr
(SEQ ID NO: 4838) Cys Glu Tyr Cys Asp Asn Pro Ala Cys Val Gly Cys Tyr
(SEQ ID NO: 4839) Cys Glu Tyr Cys Asp Asn Pro Ala Cys Val Ala Cys Tyr
(SEQ ID NO: 4840) Cys Glu Tyr Cys Asp Asn Pro Ala Cys Gly Gly Cys Tyr
(SEQ ID NO: 4841) Cys Glu Tyr Cys Asp Asn Pro Ala Cys Gly Ala Cys Tyr
(SEQ ID NO: 4842) Cys Glu Tyr Cys Asp Asn Pro Thr Cys Thr Gly Cys Tyr
(SEQ ID NO: 4843) Cys Glu Tyr Cys Asp Asn Pro Thr Cys Thr Ala Cys Tyr
(SEQ ID NO: 4844) Cys Glu Tyr Cys Asp Asn Pro Thr Cys Val Gly Cys Tyr
(SEQ ID NO: 4845) Cys Glu Tyr Cys Asp Asn Pro Thr Cys Val Ala Cys Tyr
(SEQ ID NO: 4846) Cys Glu Tyr Cys Asp Asn Pro Thr Cys Gly Gly Cys Tyr
(SEQ ID NO: 4847) Cys Glu Tyr Cys Asp Asn Pro Thr Cys Gly Ala Cys Tyr
(SEQ ID NO: 4848) Cys Glu Tyr Cys Asp Asn Gly Ala Cys Thr Gly Cys Tyr
(SEQ ID NO: 4849) Cys Glu Tyr Cys Asp Asn Gly Ala Cys Thr Ala Cys Tyr

FIG. 3

(SEQ ID NO: 4850) Cys Glu Tyr Cys Asp Asn Gly Ala Cys Val Gly Cys Tyr
(SEQ ID NO: 4851) Cys Glu Tyr Cys Asp Asn Gly Ala Cys Val Ala Cys Tyr
(SEQ ID NO: 4852) Cys Glu Tyr Cys Asp Asn Gly Ala Cys Gly Gly Cys Tyr
(SEQ ID NO: 4853) Cys Glu Tyr Cys Asp Asn Gly Ala Cys Gly Ala Cys Tyr
(SEQ ID NO: 4854) Cys Glu Tyr Cys Asp Asn Gly Thr Cys Thr Gly Cys Tyr
(SEQ ID NO: 4855) Cys Glu Tyr Cys Asp Asn Gly Thr Cys Thr Ala Cys Tyr
(SEQ ID NO: 4856) Cys Glu Tyr Cys Asp Asn Gly Thr Cys Val Gly Cys Tyr
(SEQ ID NO: 4857) Cys Glu Tyr Cys Asp Asn Gly Thr Cys Val Ala Cys Tyr
(SEQ ID NO: 4858) Cys Glu Tyr Cys Asp Asn Gly Thr Cys Gly Gly Cys Tyr
(SEQ ID NO: 4859) Cys Glu Tyr Cys Asp Asn Gly Thr Cys Gly Ala Cys Tyr
(SEQ ID NO: 4860) Cys Glu Tyr Cys Gln Asn Pro Ala Cys Thr Gly Cys Tyr
(SEQ ID NO: 4861) Cys Glu Tyr Cys Gln Asn Pro Ala Cys Thr Ala Cys Tyr
(SEQ ID NO: 4862) Cys Glu Tyr Cys Gln Asn Pro Ala Cys Val Gly Cys Tyr
(SEQ ID NO: 4863) Cys Glu Tyr Cys Gln Asn Pro Ala Cys Val Ala Cys Tyr
(SEQ ID NO: 4864) Cys Glu Tyr Cys Gln Asn Pro Ala Cys Gly Gly Cys Tyr
(SEQ ID NO: 4865) Cys Glu Tyr Cys Gln Asn Pro Ala Cys Gly Ala Cys Tyr
(SEQ ID NO: 4866) Cys Glu Tyr Cys Gln Asn Pro Thr Cys Thr Gly Cys Tyr
(SEQ ID NO: 4867) Cys Glu Tyr Cys Gln Asn Pro Thr Cys Thr Ala Cys Tyr
(SEQ ID NO: 4868) Cys Glu Tyr Cys Gln Asn Pro Thr Cys Val Gly Cys Tyr
(SEQ ID NO: 4869) Cys Glu Tyr Cys Gln Asn Pro Thr Cys Val Ala Cys Tyr
(SEQ ID NO: 4870) Cys Glu Tyr Cys Gln Asn Pro Thr Cys Gly Gly Cys Tyr
(SEQ ID NO: 4871) Cys Glu Tyr Cys Gln Asn Pro Thr Cys Gly Ala Cys Tyr
(SEQ ID NO: 4872) Cys Glu Tyr Cys Gln Asn Gly Ala Cys Thr Gly Cys Tyr
(SEQ ID NO: 4873) Cys Glu Tyr Cys Gln Asn Gly Ala Cys Thr Ala Cys Tyr
(SEQ ID NO: 4874) Cys Glu Tyr Cys Gln Asn Gly Ala Cys Val Gly Cys Tyr
(SEQ ID NO: 4875) Cys Glu Tyr Cys Gln Asn Gly Ala Cys Val Ala Cys Tyr
(SEQ ID NO: 4876) Cys Glu Tyr Cys Gln Asn Gly Ala Cys Gly Gly Cys Tyr
(SEQ ID NO: 4877) Cys Glu Tyr Cys Gln Asn Gly Ala Cys Gly Ala Cys Tyr
(SEQ ID NO: 4878) Cys Glu Tyr Cys Gln Asn Gly Thr Cys Thr Gly Cys Tyr
(SEQ ID NO: 4879) Cys Glu Tyr Cys Gln Asn Gly Thr Cys Thr Ala Cys Tyr
(SEQ ID NO: 4880) Cys Glu Tyr Cys Gln Asn Gly Thr Cys Val Gly Cys Tyr
(SEQ ID NO: 4881) Cys Glu Tyr Cys Gln Asn Gly Thr Cys Val Ala Cys Tyr
(SEQ ID NO: 4882) Cys Glu Tyr Cys Gln Asn Gly Thr Cys Gly Gly Cys Tyr
(SEQ ID NO: 4883) Cys Glu Tyr Cys Gln Asn Gly Thr Cys Gly Ala Cys Tyr
(SEQ ID NO: 4884) Cys Glu Tyr Cys Glu Asn Pro Ala Cys Thr Gly Cys Tyr
(SEQ ID NO: 4885) Cys Glu Tyr Cys Glu Asn Pro Ala Cys Thr Ala Cys Tyr
(SEQ ID NO: 4886) Cys Glu Tyr Cys Glu Asn Pro Ala Cys Val Gly Cys Tyr
(SEQ ID NO: 4887) Cys Glu Tyr Cys Glu Asn Pro Ala Cys Val Ala Cys Tyr
(SEQ ID NO: 4888) Cys Glu Tyr Cys Glu Asn Pro Ala Cys Gly Gly Cys Tyr
(SEQ ID NO: 4889) Cys Glu Tyr Cys Glu Asn Pro Ala Cys Gly Ala Cys Tyr
(SEQ ID NO: 4890) Cys Glu Tyr Cys Glu Asn Pro Thr Cys Thr Gly Cys Tyr
(SEQ ID NO: 4891) Cys Glu Tyr Cys Glu Asn Pro Thr Cys Thr Ala Cys Tyr
(SEQ ID NO: 4892) Cys Glu Tyr Cys Glu Asn Pro Thr Cys Val Gly Cys Tyr

FIG. 3

(SEQ ID NO: 4893) Cys Glu Tyr Cys Glu Asn Pro Thr Cys Val Ala Cys Tyr
(SEQ ID NO: 4894) Cys Glu Tyr Cys Glu Asn Pro Thr Cys Gly Gly Cys Tyr
(SEQ ID NO: 4895) Cys Glu Tyr Cys Glu Asn Pro Thr Cys Gly Ala Cys Tyr
(SEQ ID NO: 4896) Cys Glu Tyr Cys Glu Asn Gly Ala Cys Thr Gly Cys Tyr
(SEQ ID NO: 4897) Cys Glu Tyr Cys Glu Asn Gly Ala Cys Thr Ala Cys Tyr
(SEQ ID NO: 4898) Cys Glu Tyr Cys Glu Asn Gly Ala Cys Val Gly Cys Tyr
(SEQ ID NO: 4899) Cys Glu Tyr Cys Glu Asn Gly Ala Cys Val Ala Cys Tyr
(SEQ ID NO: 4900) Cys Glu Tyr Cys Glu Asn Gly Ala Cys Gly Gly Cys Tyr
(SEQ ID NO: 4901) Cys Glu Tyr Cys Glu Asn Gly Ala Cys Gly Ala Cys Tyr
(SEQ ID NO: 4902) Cys Glu Tyr Cys Glu Asn Gly Thr Cys Thr Gly Cys Tyr
(SEQ ID NO: 4903) Cys Glu Tyr Cys Glu Asn Gly Thr Cys Thr Ala Cys Tyr
(SEQ ID NO: 4904) Cys Glu Tyr Cys Glu Asn Gly Thr Cys Val Gly Cys Tyr
(SEQ ID NO: 4905) Cys Glu Tyr Cys Glu Asn Gly Thr Cys Val Ala Cys Tyr
(SEQ ID NO: 4906) Cys Glu Tyr Cys Glu Asn Gly Thr Cys Gly Gly Cys Tyr
(SEQ ID NO: 4907) Cys Glu Tyr Cys Glu Asn Gly Thr Cys Gly Ala Cys Tyr
(SEQ ID NO: 4908) Cys Glu Tyr Cys Gly Asn Pro Ala Cys Thr Gly Cys Tyr
(SEQ ID NO: 4909) Cys Glu Tyr Cys Gly Asn Pro Ala Cys Thr Ala Cys Tyr
(SEQ ID NO: 4910) Cys Glu Tyr Cys Gly Asn Pro Ala Cys Val Gly Cys Tyr
(SEQ ID NO: 4911) Cys Glu Tyr Cys Gly Asn Pro Ala Cys Val Ala Cys Tyr
(SEQ ID NO: 4912) Cys Glu Tyr Cys Gly Asn Pro Ala Cys Gly Gly Cys Tyr
(SEQ ID NO: 4913) Cys Glu Tyr Cys Gly Asn Pro Ala Cys Gly Ala Cys Tyr
(SEQ ID NO: 4914) Cys Glu Tyr Cys Gly Asn Pro Thr Cys Thr Gly Cys Tyr
(SEQ ID NO: 4915) Cys Glu Tyr Cys Gly Asn Pro Thr Cys Thr Ala Cys Tyr
(SEQ ID NO: 4916) Cys Glu Tyr Cys Gly Asn Pro Thr Cys Val Gly Cys Tyr
(SEQ ID NO: 4917) Cys Glu Tyr Cys Gly Asn Pro Thr Cys Val Ala Cys Tyr
(SEQ ID NO: 4918) Cys Glu Tyr Cys Gly Asn Pro Thr Cys Gly Gly Cys Tyr
(SEQ ID NO: 4919) Cys Glu Tyr Cys Gly Asn Pro Thr Cys Gly Ala Cys Tyr
(SEQ ID NO: 4920) Cys Glu Tyr Cys Gly Asn Gly Ala Cys Thr Gly Cys Tyr
(SEQ ID NO: 4921) Cys Glu Tyr Cys Gly Asn Gly Ala Cys Thr Ala Cys Tyr
(SEQ ID NO: 4922) Cys Glu Tyr Cys Gly Asn Gly Ala Cys Val Gly Cys Tyr
(SEQ ID NO: 4923) Cys Glu Tyr Cys Gly Asn Gly Ala Cys Val Ala Cys Tyr
(SEQ ID NO: 4924) Cys Glu Tyr Cys Gly Asn Gly Ala Cys Gly Gly Cys Tyr
(SEQ ID NO: 4925) Cys Glu Tyr Cys Gly Asn Gly Ala Cys Gly Ala Cys Tyr
(SEQ ID NO: 4926) Cys Glu Tyr Cys Gly Asn Gly Thr Cys Thr Gly Cys Tyr
(SEQ ID NO: 4927) Cys Glu Tyr Cys Gly Asn Gly Thr Cys Thr Ala Cys Tyr
(SEQ ID NO: 4928) Cys Glu Tyr Cys Gly Asn Gly Thr Cys Val Gly Cys Tyr
(SEQ ID NO: 4929) Cys Glu Tyr Cys Gly Asn Gly Thr Cys Val Ala Cys Tyr
(SEQ ID NO: 4930) Cys Glu Tyr Cys Gly Asn Gly Thr Cys Gly Gly Cys Tyr
(SEQ ID NO: 4931) Cys Glu Tyr Cys Gly Asn Gly Thr Cys Gly Ala Cys Tyr
(SEQ ID NO: 4932) Cys Glu Tyr Cys His Asn Pro Ala Cys Thr Gly Cys Tyr
(SEQ ID NO: 4933) Cys Glu Tyr Cys His Asn Pro Ala Cys Thr Ala Cys Tyr
(SEQ ID NO: 4934) Cys Glu Tyr Cys His Asn Pro Ala Cys Val Gly Cys Tyr
(SEQ ID NO: 4935) Cys Glu Tyr Cys His Asn Pro Ala Cys Val Ala Cys Tyr

FIG. 3

| | |
|---|---|
| (SEQ ID NO: 4936) | Cys Glu Tyr Cys His Asn Pro Ala Cys Gly Gly Cys Tyr |
| (SEQ ID NO: 4937) | Cys Glu Tyr Cys His Asn Pro Ala Cys Gly Ala Cys Tyr |
| (SEQ ID NO: 4938) | Cys Glu Tyr Cys His Asn Pro Thr Cys Thr Gly Cys Tyr |
| (SEQ ID NO: 4939) | Cys Glu Tyr Cys His Asn Pro Thr Cys Thr Ala Cys Tyr |
| (SEQ ID NO: 4940) | Cys Glu Tyr Cys His Asn Pro Thr Cys Val Gly Cys Tyr |
| (SEQ ID NO: 4941) | Cys Glu Tyr Cys His Asn Pro Thr Cys Val Ala Cys Tyr |
| (SEQ ID NO: 4942) | Cys Glu Tyr Cys His Asn Pro Thr Cys Gly Gly Cys Tyr |
| (SEQ ID NO: 4943) | Cys Glu Tyr Cys His Asn Pro Thr Cys Gly Ala Cys Tyr |
| (SEQ ID NO: 4944) | Cys Glu Tyr Cys His Asn Gly Ala Cys Thr Gly Cys Tyr |
| (SEQ ID NO: 4945) | Cys Glu Tyr Cys His Asn Gly Ala Cys Thr Ala Cys Tyr |
| (SEQ ID NO: 4946) | Cys Glu Tyr Cys His Asn Gly Ala Cys Val Gly Cys Tyr |
| (SEQ ID NO: 4947) | Cys Glu Tyr Cys His Asn Gly Ala Cys Val Ala Cys Tyr |
| (SEQ ID NO: 4948) | Cys Glu Tyr Cys His Asn Gly Ala Cys Gly Gly Cys Tyr |
| (SEQ ID NO: 4949) | Cys Glu Tyr Cys His Asn Gly Ala Cys Gly Ala Cys Tyr |
| (SEQ ID NO: 4950) | Cys Glu Tyr Cys His Asn Gly Thr Cys Thr Gly Cys Tyr |
| (SEQ ID NO: 4951) | Cys Glu Tyr Cys His Asn Gly Thr Cys Thr Ala Cys Tyr |
| (SEQ ID NO: 4952) | Cys Glu Tyr Cys His Asn Gly Thr Cys Val Gly Cys Tyr |
| (SEQ ID NO: 4953) | Cys Glu Tyr Cys His Asn Gly Thr Cys Val Ala Cys Tyr |
| (SEQ ID NO: 4954) | Cys Glu Tyr Cys His Asn Gly Thr Cys Gly Gly Cys Tyr |
| (SEQ ID NO: 4955) | Cys Glu Tyr Cys His Asn Gly Thr Cys Gly Ala Cys Tyr |
| (SEQ ID NO: 4956) | Cys Glu Tyr Cys Ile Asn Pro Ala Cys Thr Gly Cys Tyr |
| (SEQ ID NO: 4957) | Cys Glu Tyr Cys Ile Asn Pro Ala Cys Thr Ala Cys Tyr |
| (SEQ ID NO: 4958) | Cys Glu Tyr Cys Ile Asn Pro Ala Cys Val Gly Cys Tyr |
| (SEQ ID NO: 4959) | Cys Glu Tyr Cys Ile Asn Pro Ala Cys Val Ala Cys Tyr |
| (SEQ ID NO: 4960) | Cys Glu Tyr Cys Ile Asn Pro Ala Cys Gly Gly Cys Tyr |
| (SEQ ID NO: 4961) | Cys Glu Tyr Cys Ile Asn Pro Ala Cys Gly Ala Cys Tyr |
| (SEQ ID NO: 4962) | Cys Glu Tyr Cys Ile Asn Pro Thr Cys Thr Gly Cys Tyr |
| (SEQ ID NO: 4963) | Cys Glu Tyr Cys Ile Asn Pro Thr Cys Thr Ala Cys Tyr |
| (SEQ ID NO: 4964) | Cys Glu Tyr Cys Ile Asn Pro Thr Cys Val Gly Cys Tyr |
| (SEQ ID NO: 4965) | Cys Glu Tyr Cys Ile Asn Pro Thr Cys Val Ala Cys Tyr |
| (SEQ ID NO: 4966) | Cys Glu Tyr Cys Ile Asn Pro Thr Cys Gly Gly Cys Tyr |
| (SEQ ID NO: 4967) | Cys Glu Tyr Cys Ile Asn Pro Thr Cys Gly Ala Cys Tyr |
| (SEQ ID NO: 4968) | Cys Glu Tyr Cys Ile Asn Gly Ala Cys Thr Gly Cys Tyr |
| (SEQ ID NO: 4969) | Cys Glu Tyr Cys Ile Asn Gly Ala Cys Thr Ala Cys Tyr |
| (SEQ ID NO: 4970) | Cys Glu Tyr Cys Ile Asn Gly Ala Cys Val Gly Cys Tyr |
| (SEQ ID NO: 4971) | Cys Glu Tyr Cys Ile Asn Gly Ala Cys Val Ala Cys Tyr |
| (SEQ ID NO: 4972) | Cys Glu Tyr Cys Ile Asn Gly Ala Cys Gly Gly Cys Tyr |
| (SEQ ID NO: 4973) | Cys Glu Tyr Cys Ile Asn Gly Ala Cys Gly Ala Cys Tyr |
| (SEQ ID NO: 4974) | Cys Glu Tyr Cys Ile Asn Gly Thr Cys Thr Gly Cys Tyr |
| (SEQ ID NO: 4975) | Cys Glu Tyr Cys Ile Asn Gly Thr Cys Thr Ala Cys Tyr |
| (SEQ ID NO: 4976) | Cys Glu Tyr Cys Ile Asn Gly Thr Cys Val Gly Cys Tyr |
| (SEQ ID NO: 4977) | Cys Glu Tyr Cys Ile Asn Gly Thr Cys Val Ala Cys Tyr |
| (SEQ ID NO: 4978) | Cys Glu Tyr Cys Ile Asn Gly Thr Cys Gly Gly Cys Tyr |

FIG. 3

(SEQ ID NO: 4979)  Cys Glu Tyr Cys Ile Asn Gly Thr Cys Gly Ala Cys Tyr
(SEQ ID NO: 4980)  Cys Glu Tyr Cys Leu Asn Pro Ala Cys Thr Gly Cys Tyr
(SEQ ID NO: 4981)  Cys Glu Tyr Cys Leu Asn Pro Ala Cys Thr Ala Cys Tyr
(SEQ ID NO: 4982)  Cys Glu Tyr Cys Leu Asn Pro Ala Cys Val Gly Cys Tyr
(SEQ ID NO: 4983)  Cys Glu Tyr Cys Leu Asn Pro Ala Cys Val Ala Cys Tyr
(SEQ ID NO: 4984)  Cys Glu Tyr Cys Leu Asn Pro Ala Cys Gly Gly Cys Tyr
(SEQ ID NO: 4985)  Cys Glu Tyr Cys Leu Asn Pro Ala Cys Gly Ala Cys Tyr
(SEQ ID NO: 4986)  Cys Glu Tyr Cys Leu Asn Pro Thr Cys Thr Gly Cys Tyr
(SEQ ID NO: 4987)  Cys Glu Tyr Cys Leu Asn Pro Thr Cys Thr Ala Cys Tyr
(SEQ ID NO: 4988)  Cys Glu Tyr Cys Leu Asn Pro Thr Cys Val Gly Cys Tyr
(SEQ ID NO: 4989)  Cys Glu Tyr Cys Leu Asn Pro Thr Cys Val Ala Cys Tyr
(SEQ ID NO: 4990)  Cys Glu Tyr Cys Leu Asn Pro Thr Cys Gly Gly Cys Tyr
(SEQ ID NO: 4991)  Cys Glu Tyr Cys Leu Asn Pro Thr Cys Gly Ala Cys Tyr
(SEQ ID NO: 4992)  Cys Glu Tyr Cys Leu Asn Gly Ala Cys Thr Gly Cys Tyr
(SEQ ID NO: 4993)  Cys Glu Tyr Cys Leu Asn Gly Ala Cys Thr Ala Cys Tyr
(SEQ ID NO: 4994)  Cys Glu Tyr Cys Leu Asn Gly Ala Cys Val Gly Cys Tyr
(SEQ ID NO: 4995)  Cys Glu Tyr Cys Leu Asn Gly Ala Cys Val Ala Cys Tyr
(SEQ ID NO: 4996)  Cys Glu Tyr Cys Leu Asn Gly Ala Cys Gly Gly Cys Tyr
(SEQ ID NO: 4997)  Cys Glu Tyr Cys Leu Asn Gly Ala Cys Gly Ala Cys Tyr
(SEQ ID NO: 4998)  Cys Glu Tyr Cys Leu Asn Gly Thr Cys Thr Gly Cys Tyr
(SEQ ID NO: 4999)  Cys Glu Tyr Cys Leu Asn Gly Thr Cys Thr Ala Cys Tyr
(SEQ ID NO: 5000)  Cys Glu Tyr Cys Leu Asn Gly Thr Cys Val Gly Cys Tyr
(SEQ ID NO: 5001)  Cys Glu Tyr Cys Leu Asn Gly Thr Cys Val Ala Cys Tyr
(SEQ ID NO: 5002)  Cys Glu Tyr Cys Leu Asn Gly Thr Cys Gly Gly Cys Tyr
(SEQ ID NO: 5003)  Cys Glu Tyr Cys Leu Asn Gly Thr Cys Gly Ala Cys Tyr
(SEQ ID NO: 5004)  Cys Glu Tyr Cys Lys Asn Pro Ala Cys Thr Gly Cys Tyr
(SEQ ID NO: 5005)  Cys Glu Tyr Cys Lys Asn Pro Ala Cys Thr Ala Cys Tyr
(SEQ ID NO: 5006)  Cys Glu Tyr Cys Lys Asn Pro Ala Cys Val Gly Cys Tyr
(SEQ ID NO: 5007)  Cys Glu Tyr Cys Lys Asn Pro Ala Cys Val Ala Cys Tyr
(SEQ ID NO: 5008)  Cys Glu Tyr Cys Lys Asn Pro Ala Cys Gly Gly Cys Tyr
(SEQ ID NO: 5009)  Cys Glu Tyr Cys Lys Asn Pro Ala Cys Gly Ala Cys Tyr
(SEQ ID NO: 5010)  Cys Glu Tyr Cys Lys Asn Pro Thr Cys Thr Gly Cys Tyr
(SEQ ID NO: 5011)  Cys Glu Tyr Cys Lys Asn Pro Thr Cys Thr Ala Cys Tyr
(SEQ ID NO: 5012)  Cys Glu Tyr Cys Lys Asn Pro Thr Cys Val Gly Cys Tyr
(SEQ ID NO: 5013)  Cys Glu Tyr Cys Lys Asn Pro Thr Cys Val Ala Cys Tyr
(SEQ ID NO: 5014)  Cys Glu Tyr Cys Lys Asn Pro Thr Cys Gly Gly Cys Tyr
(SEQ ID NO: 5015)  Cys Glu Tyr Cys Lys Asn Pro Thr Cys Gly Ala Cys Tyr
(SEQ ID NO: 5016)  Cys Glu Tyr Cys Lys Asn Gly Ala Cys Thr Gly Cys Tyr
(SEQ ID NO: 5017)  Cys Glu Tyr Cys Lys Asn Gly Ala Cys Thr Ala Cys Tyr
(SEQ ID NO: 5018)  Cys Glu Tyr Cys Lys Asn Gly Ala Cys Val Gly Cys Tyr
(SEQ ID NO: 5019)  Cys Glu Tyr Cys Lys Asn Gly Ala Cys Val Ala Cys Tyr
(SEQ ID NO: 5020)  Cys Glu Tyr Cys Lys Asn Gly Ala Cys Gly Gly Cys Tyr
(SEQ ID NO: 5021)  Cys Glu Tyr Cys Lys Asn Gly Ala Cys Gly Ala Cys Tyr

FIG. 3

(SEQ ID NO: 5022)  Cys Glu Tyr Cys Lys Asn Gly Thr Cys Thr Gly Cys Tyr
(SEQ ID NO: 5023)  Cys Glu Tyr Cys Lys Asn Gly Thr Cys Thr Ala Cys Tyr
(SEQ ID NO: 5024)  Cys Glu Tyr Cys Lys Asn Gly Thr Cys Val Gly Cys Tyr
(SEQ ID NO: 5025)  Cys Glu Tyr Cys Lys Asn Gly Thr Cys Val Ala Cys Tyr
(SEQ ID NO: 5026)  Cys Glu Tyr Cys Lys Asn Gly Thr Cys Gly Gly Cys Tyr
(SEQ ID NO: 5027)  Cys Glu Tyr Cys Lys Asn Gly Thr Cys Gly Ala Cys Tyr
(SEQ ID NO: 5028)  Cys Glu Tyr Cys Met Asn Pro Ala Cys Thr Gly Cys Tyr
(SEQ ID NO: 5029)  Cys Glu Tyr Cys Met Asn Pro Ala Cys Thr Ala Cys Tyr
(SEQ ID NO: 5030)  Cys Glu Tyr Cys Met Asn Pro Ala Cys Val Gly Cys Tyr
(SEQ ID NO: 5031)  Cys Glu Tyr Cys Met Asn Pro Ala Cys Val Ala Cys Tyr
(SEQ ID NO: 5032)  Cys Glu Tyr Cys Met Asn Pro Ala Cys Gly Gly Cys Tyr
(SEQ ID NO: 5033)  Cys Glu Tyr Cys Met Asn Pro Ala Cys Gly Ala Cys Tyr
(SEQ ID NO: 5034)  Cys Glu Tyr Cys Met Asn Pro Thr Cys Thr Gly Cys Tyr
(SEQ ID NO: 5035)  Cys Glu Tyr Cys Met Asn Pro Thr Cys Thr Ala Cys Tyr
(SEQ ID NO: 5036)  Cys Glu Tyr Cys Met Asn Pro Thr Cys Val Gly Cys Tyr
(SEQ ID NO: 5037)  Cys Glu Tyr Cys Met Asn Pro Thr Cys Val Ala Cys Tyr
(SEQ ID NO: 5038)  Cys Glu Tyr Cys Met Asn Pro Thr Cys Gly Gly Cys Tyr
(SEQ ID NO: 5039)  Cys Glu Tyr Cys Met Asn Pro Thr Cys Gly Ala Cys Tyr
(SEQ ID NO: 5040)  Cys Glu Tyr Cys Met Asn Gly Ala Cys Thr Gly Cys Tyr
(SEQ ID NO: 5041)  Cys Glu Tyr Cys Met Asn Gly Ala Cys Thr Ala Cys Tyr
(SEQ ID NO: 5042)  Cys Glu Tyr Cys Met Asn Gly Ala Cys Val Gly Cys Tyr
(SEQ ID NO: 5043)  Cys Glu Tyr Cys Met Asn Gly Ala Cys Val Ala Cys Tyr
(SEQ ID NO: 5044)  Cys Glu Tyr Cys Met Asn Gly Ala Cys Gly Gly Cys Tyr
(SEQ ID NO: 5045)  Cys Glu Tyr Cys Met Asn Gly Ala Cys Gly Ala Cys Tyr
(SEQ ID NO: 5046)  Cys Glu Tyr Cys Met Asn Gly Thr Cys Thr Gly Cys Tyr
(SEQ ID NO: 5047)  Cys Glu Tyr Cys Met Asn Gly Thr Cys Thr Ala Cys Tyr
(SEQ ID NO: 5048)  Cys Glu Tyr Cys Met Asn Gly Thr Cys Val Gly Cys Tyr
(SEQ ID NO: 5049)  Cys Glu Tyr Cys Met Asn Gly Thr Cys Val Ala Cys Tyr
(SEQ ID NO: 5050)  Cys Glu Tyr Cys Met Asn Gly Thr Cys Gly Gly Cys Tyr
(SEQ ID NO: 5051)  Cys Glu Tyr Cys Met Asn Gly Thr Cys Gly Ala Cys Tyr
(SEQ ID NO: 5052)  Cys Glu Tyr Cys Phe Asn Pro Ala Cys Thr Gly Cys Tyr
(SEQ ID NO: 5053)  Cys Glu Tyr Cys Phe Asn Pro Ala Cys Thr Ala Cys Tyr
(SEQ ID NO: 5054)  Cys Glu Tyr Cys Phe Asn Pro Ala Cys Val Gly Cys Tyr
(SEQ ID NO: 5055)  Cys Glu Tyr Cys Phe Asn Pro Ala Cys Val Ala Cys Tyr
(SEQ ID NO: 5056)  Cys Glu Tyr Cys Phe Asn Pro Ala Cys Gly Gly Cys Tyr
(SEQ ID NO: 5057)  Cys Glu Tyr Cys Phe Asn Pro Ala Cys Gly Ala Cys Tyr
(SEQ ID NO: 5058)  Cys Glu Tyr Cys Phe Asn Pro Thr Cys Thr Gly Cys Tyr
(SEQ ID NO: 5059)  Cys Glu Tyr Cys Phe Asn Pro Thr Cys Thr Ala Cys Tyr
(SEQ ID NO: 5060)  Cys Glu Tyr Cys Phe Asn Pro Thr Cys Val Gly Cys Tyr
(SEQ ID NO: 5061)  Cys Glu Tyr Cys Phe Asn Pro Thr Cys Val Ala Cys Tyr
(SEQ ID NO: 5062)  Cys Glu Tyr Cys Phe Asn Pro Thr Cys Gly Gly Cys Tyr
(SEQ ID NO: 5063)  Cys Glu Tyr Cys Phe Asn Pro Thr Cys Gly Ala Cys Tyr
(SEQ ID NO: 5064)  Cys Glu Tyr Cys Phe Asn Gly Ala Cys Thr Gly Cys Tyr

FIG. 3

(SEQ ID NO: 5065)  Cys Glu Tyr Cys Phe Asn Gly Ala Cys Thr Ala Cys Tyr
(SEQ ID NO: 5066)  Cys Glu Tyr Cys Phe Asn Gly Ala Cys Val Gly Cys Tyr
(SEQ ID NO: 5067)  Cys Glu Tyr Cys Phe Asn Gly Ala Cys Val Ala Cys Tyr
(SEQ ID NO: 5068)  Cys Glu Tyr Cys Phe Asn Gly Ala Cys Gly Gly Cys Tyr
(SEQ ID NO: 5069)  Cys Glu Tyr Cys Phe Asn Gly Ala Cys Gly Ala Cys Tyr
(SEQ ID NO: 5070)  Cys Glu Tyr Cys Phe Asn Gly Thr Cys Thr Gly Cys Tyr
(SEQ ID NO: 5071)  Cys Glu Tyr Cys Phe Asn Gly Thr Cys Thr Ala Cys Tyr
(SEQ ID NO: 5072)  Cys Glu Tyr Cys Phe Asn Gly Thr Cys Val Gly Cys Tyr
(SEQ ID NO: 5073)  Cys Glu Tyr Cys Phe Asn Gly Thr Cys Val Ala Cys Tyr
(SEQ ID NO: 5074)  Cys Glu Tyr Cys Phe Asn Gly Thr Cys Gly Gly Cys Tyr
(SEQ ID NO: 5075)  Cys Glu Tyr Cys Phe Asn Gly Thr Cys Gly Ala Cys Tyr
(SEQ ID NO: 5076)  Cys Glu Tyr Cys Pro Asn Pro Ala Cys Thr Gly Cys Tyr
(SEQ ID NO: 5077)  Cys Glu Tyr Cys Pro Asn Pro Ala Cys Thr Ala Cys Tyr
(SEQ ID NO: 5078)  Cys Glu Tyr Cys Pro Asn Pro Ala Cys Val Gly Cys Tyr
(SEQ ID NO: 5079)  Cys Glu Tyr Cys Pro Asn Pro Ala Cys Val Ala Cys Tyr
(SEQ ID NO: 5080)  Cys Glu Tyr Cys Pro Asn Pro Ala Cys Gly Gly Cys Tyr
(SEQ ID NO: 5081)  Cys Glu Tyr Cys Pro Asn Pro Ala Cys Gly Ala Cys Tyr
(SEQ ID NO: 5082)  Cys Glu Tyr Cys Pro Asn Pro Thr Cys Thr Gly Cys Tyr
(SEQ ID NO: 5083)  Cys Glu Tyr Cys Pro Asn Pro Thr Cys Thr Ala Cys Tyr
(SEQ ID NO: 5084)  Cys Glu Tyr Cys Pro Asn Pro Thr Cys Val Gly Cys Tyr
(SEQ ID NO: 5085)  Cys Glu Tyr Cys Pro Asn Pro Thr Cys Val Ala Cys Tyr
(SEQ ID NO: 5086)  Cys Glu Tyr Cys Pro Asn Pro Thr Cys Gly Gly Cys Tyr
(SEQ ID NO: 5087)  Cys Glu Tyr Cys Pro Asn Pro Thr Cys Gly Ala Cys Tyr
(SEQ ID NO: 5088)  Cys Glu Tyr Cys Pro Asn Gly Ala Cys Thr Gly Cys Tyr
(SEQ ID NO: 5089)  Cys Glu Tyr Cys Pro Asn Gly Ala Cys Thr Ala Cys Tyr
(SEQ ID NO: 5090)  Cys Glu Tyr Cys Pro Asn Gly Ala Cys Val Gly Cys Tyr
(SEQ ID NO: 5091)  Cys Glu Tyr Cys Pro Asn Gly Ala Cys Val Ala Cys Tyr
(SEQ ID NO: 5092)  Cys Glu Tyr Cys Pro Asn Gly Ala Cys Gly Gly Cys Tyr
(SEQ ID NO: 5093)  Cys Glu Tyr Cys Pro Asn Gly Ala Cys Gly Ala Cys Tyr
(SEQ ID NO: 5094)  Cys Glu Tyr Cys Pro Asn Gly Thr Cys Thr Gly Cys Tyr
(SEQ ID NO: 5095)  Cys Glu Tyr Cys Pro Asn Gly Thr Cys Thr Ala Cys Tyr
(SEQ ID NO: 5096)  Cys Glu Tyr Cys Pro Asn Gly Thr Cys Val Gly Cys Tyr
(SEQ ID NO: 5097)  Cys Glu Tyr Cys Pro Asn Gly Thr Cys Val Ala Cys Tyr
(SEQ ID NO: 5098)  Cys Glu Tyr Cys Pro Asn Gly Thr Cys Gly Gly Cys Tyr
(SEQ ID NO: 5099)  Cys Glu Tyr Cys Pro Asn Gly Thr Cys Gly Ala Cys Tyr
(SEQ ID NO: 5100)  Cys Glu Tyr Cys Ser Asn Pro Ala Cys Thr Gly Cys Tyr
(SEQ ID NO: 5101)  Cys Glu Tyr Cys Ser Asn Pro Ala Cys Thr Ala Cys Tyr
(SEQ ID NO: 5102)  Cys Glu Tyr Cys Ser Asn Pro Ala Cys Val Gly Cys Tyr
(SEQ ID NO: 5103)  Cys Glu Tyr Cys Ser Asn Pro Ala Cys Val Ala Cys Tyr
(SEQ ID NO: 5104)  Cys Glu Tyr Cys Ser Asn Pro Ala Cys Gly Gly Cys Tyr
(SEQ ID NO: 5105)  Cys Glu Tyr Cys Ser Asn Pro Ala Cys Gly Ala Cys Tyr
(SEQ ID NO: 5106)  Cys Glu Tyr Cys Ser Asn Pro Thr Cys Thr Gly Cys Tyr
(SEQ ID NO: 5107)  Cys Glu Tyr Cys Ser Asn Pro Thr Cys Thr Ala Cys Tyr

FIG. 3

(SEQ ID NO: 5108)  Cys Glu Tyr Cys Ser Asn Pro Thr Cys Val Gly Cys Tyr
(SEQ ID NO: 5109)  Cys Glu Tyr Cys Ser Asn Pro Thr Cys Val Ala Cys Tyr
(SEQ ID NO: 5110)  Cys Glu Tyr Cys Ser Asn Pro Thr Cys Gly Gly Cys Tyr
(SEQ ID NO: 5111)  Cys Glu Tyr Cys Ser Asn Pro Thr Cys Gly Ala Cys Tyr
(SEQ ID NO: 5112)  Cys Glu Tyr Cys Ser Asn Gly Ala Cys Thr Gly Cys Tyr
(SEQ ID NO: 5113)  Cys Glu Tyr Cys Ser Asn Gly Ala Cys Thr Ala Cys Tyr
(SEQ ID NO: 5114)  Cys Glu Tyr Cys Ser Asn Gly Ala Cys Val Gly Cys Tyr
(SEQ ID NO: 5115)  Cys Glu Tyr Cys Ser Asn Gly Ala Cys Val Ala Cys Tyr
(SEQ ID NO: 5116)  Cys Glu Tyr Cys Ser Asn Gly Ala Cys Gly Gly Cys Tyr
(SEQ ID NO: 5117)  Cys Glu Tyr Cys Ser Asn Gly Ala Cys Gly Ala Cys Tyr
(SEQ ID NO: 5118)  Cys Glu Tyr Cys Ser Asn Gly Thr Cys Thr Gly Cys Tyr
(SEQ ID NO: 5119)  Cys Glu Tyr Cys Ser Asn Gly Thr Cys Thr Ala Cys Tyr
(SEQ ID NO: 5120)  Cys Glu Tyr Cys Ser Asn Gly Thr Cys Val Gly Cys Tyr
(SEQ ID NO: 5121)  Cys Glu Tyr Cys Ser Asn Gly Thr Cys Val Ala Cys Tyr
(SEQ ID NO: 5122)  Cys Glu Tyr Cys Ser Asn Gly Thr Cys Gly Gly Cys Tyr
(SEQ ID NO: 5123)  Cys Glu Tyr Cys Ser Asn Gly Thr Cys Gly Ala Cys Tyr
(SEQ ID NO: 5124)  Cys Glu Tyr Cys Thr Asn Pro Ala Cys Thr Gly Cys Tyr
(SEQ ID NO: 5125)  Cys Glu Tyr Cys Thr Asn Pro Ala Cys Thr Ala Cys Tyr
(SEQ ID NO: 5126)  Cys Glu Tyr Cys Thr Asn Pro Ala Cys Val Gly Cys Tyr
(SEQ ID NO: 5127)  Cys Glu Tyr Cys Thr Asn Pro Ala Cys Val Ala Cys Tyr
(SEQ ID NO: 5128)  Cys Glu Tyr Cys Thr Asn Pro Ala Cys Gly Gly Cys Tyr
(SEQ ID NO: 5129)  Cys Glu Tyr Cys Thr Asn Pro Ala Cys Gly Ala Cys Tyr
(SEQ ID NO: 5130)  Cys Glu Tyr Cys Thr Asn Pro Thr Cys Thr Gly Cys Tyr
(SEQ ID NO: 5131)  Cys Glu Tyr Cys Thr Asn Pro Thr Cys Thr Ala Cys Tyr
(SEQ ID NO: 5132)  Cys Glu Tyr Cys Thr Asn Pro Thr Cys Val Gly Cys Tyr
(SEQ ID NO: 5133)  Cys Glu Tyr Cys Thr Asn Pro Thr Cys Val Ala Cys Tyr
(SEQ ID NO: 5134)  Cys Glu Tyr Cys Thr Asn Pro Thr Cys Gly Gly Cys Tyr
(SEQ ID NO: 5135)  Cys Glu Tyr Cys Thr Asn Pro Thr Cys Gly Ala Cys Tyr
(SEQ ID NO: 5136)  Cys Glu Tyr Cys Thr Asn Gly Ala Cys Thr Gly Cys Tyr
(SEQ ID NO: 5137)  Cys Glu Tyr Cys Thr Asn Gly Ala Cys Thr Ala Cys Tyr
(SEQ ID NO: 5138)  Cys Glu Tyr Cys Thr Asn Gly Ala Cys Val Gly Cys Tyr
(SEQ ID NO: 5139)  Cys Glu Tyr Cys Thr Asn Gly Ala Cys Val Ala Cys Tyr
(SEQ ID NO: 5140)  Cys Glu Tyr Cys Thr Asn Gly Ala Cys Gly Gly Cys Tyr
(SEQ ID NO: 5141)  Cys Glu Tyr Cys Thr Asn Gly Ala Cys Gly Ala Cys Tyr
(SEQ ID NO: 5142)  Cys Glu Tyr Cys Thr Asn Gly Thr Cys Thr Gly Cys Tyr
(SEQ ID NO: 5143)  Cys Glu Tyr Cys Thr Asn Gly Thr Cys Thr Ala Cys Tyr
(SEQ ID NO: 5144)  Cys Glu Tyr Cys Thr Asn Gly Thr Cys Val Gly Cys Tyr
(SEQ ID NO: 5145)  Cys Glu Tyr Cys Thr Asn Gly Thr Cys Val Ala Cys Tyr
(SEQ ID NO: 5146)  Cys Glu Tyr Cys Thr Asn Gly Thr Cys Gly Gly Cys Tyr
(SEQ ID NO: 5147)  Cys Glu Tyr Cys Thr Asn Gly Thr Cys Gly Ala Cys Tyr
(SEQ ID NO: 5148)  Cys Glu Tyr Cys Trp Asn Pro Ala Cys Thr Gly Cys Tyr
(SEQ ID NO: 5149)  Cys Glu Tyr Cys Trp Asn Pro Ala Cys Thr Ala Cys Tyr
(SEQ ID NO: 5150)  Cys Glu Tyr Cys Trp Asn Pro Ala Cys Val Gly Cys Tyr

FIG. 3

(SEQ ID NO: 5151) Cys Glu Tyr Cys Trp Asn Pro Ala Cys Val Ala Cys Tyr
(SEQ ID NO: 5152) Cys Glu Tyr Cys Trp Asn Pro Ala Cys Gly Gly Cys Tyr
(SEQ ID NO: 5153) Cys Glu Tyr Cys Trp Asn Pro Ala Cys Gly Ala Cys Tyr
(SEQ ID NO: 5154) Cys Glu Tyr Cys Trp Asn Pro Thr Cys Thr Gly Cys Tyr
(SEQ ID NO: 5155) Cys Glu Tyr Cys Trp Asn Pro Thr Cys Thr Ala Cys Tyr
(SEQ ID NO: 5156) Cys Glu Tyr Cys Trp Asn Pro Thr Cys Val Gly Cys Tyr
(SEQ ID NO: 5157) Cys Glu Tyr Cys Trp Asn Pro Thr Cys Val Ala Cys Tyr
(SEQ ID NO: 5158) Cys Glu Tyr Cys Trp Asn Pro Thr Cys Gly Gly Cys Tyr
(SEQ ID NO: 5159) Cys Glu Tyr Cys Trp Asn Pro Thr Cys Gly Ala Cys Tyr
(SEQ ID NO: 5160) Cys Glu Tyr Cys Trp Asn Gly Ala Cys Thr Gly Cys Tyr
(SEQ ID NO: 5161) Cys Glu Tyr Cys Trp Asn Gly Ala Cys Thr Ala Cys Tyr
(SEQ ID NO: 5162) Cys Glu Tyr Cys Trp Asn Gly Ala Cys Val Gly Cys Tyr
(SEQ ID NO: 5163) Cys Glu Tyr Cys Trp Asn Gly Ala Cys Val Ala Cys Tyr
(SEQ ID NO: 5164) Cys Glu Tyr Cys Trp Asn Gly Ala Cys Gly Gly Cys Tyr
(SEQ ID NO: 5165) Cys Glu Tyr Cys Trp Asn Gly Ala Cys Gly Ala Cys Tyr
(SEQ ID NO: 5166) Cys Glu Tyr Cys Trp Asn Gly Thr Cys Thr Gly Cys Tyr
(SEQ ID NO: 5167) Cys Glu Tyr Cys Trp Asn Gly Thr Cys Thr Ala Cys Tyr
(SEQ ID NO: 5168) Cys Glu Tyr Cys Trp Asn Gly Thr Cys Val Gly Cys Tyr
(SEQ ID NO: 5169) Cys Glu Tyr Cys Trp Asn Gly Thr Cys Val Ala Cys Tyr
(SEQ ID NO: 5170) Cys Glu Tyr Cys Trp Asn Gly Thr Cys Gly Gly Cys Tyr
(SEQ ID NO: 5171) Cys Glu Tyr Cys Trp Asn Gly Thr Cys Gly Ala Cys Tyr
(SEQ ID NO: 5172) Cys Glu Tyr Cys Tyr Asn Pro Ala Cys Thr Gly Cys Tyr
(SEQ ID NO: 5173) Cys Glu Tyr Cys Tyr Asn Pro Ala Cys Thr Ala Cys Tyr
(SEQ ID NO: 5174) Cys Glu Tyr Cys Tyr Asn Pro Ala Cys Val Gly Cys Tyr
(SEQ ID NO: 5175) Cys Glu Tyr Cys Tyr Asn Pro Ala Cys Val Ala Cys Tyr
(SEQ ID NO: 5176) Cys Glu Tyr Cys Tyr Asn Pro Ala Cys Gly Gly Cys Tyr
(SEQ ID NO: 5177) Cys Glu Tyr Cys Tyr Asn Pro Ala Cys Gly Ala Cys Tyr
(SEQ ID NO: 5178) Cys Glu Tyr Cys Tyr Asn Pro Thr Cys Thr Gly Cys Tyr
(SEQ ID NO: 5179) Cys Glu Tyr Cys Tyr Asn Pro Thr Cys Thr Ala Cys Tyr
(SEQ ID NO: 5180) Cys Glu Tyr Cys Tyr Asn Pro Thr Cys Val Gly Cys Tyr
(SEQ ID NO: 5181) Cys Glu Tyr Cys Tyr Asn Pro Thr Cys Val Ala Cys Tyr
(SEQ ID NO: 5182) Cys Glu Tyr Cys Tyr Asn Pro Thr Cys Gly Gly Cys Tyr
(SEQ ID NO: 5183) Cys Glu Tyr Cys Tyr Asn Pro Thr Cys Gly Ala Cys Tyr
(SEQ ID NO: 5184) Cys Glu Tyr Cys Tyr Asn Gly Ala Cys Thr Gly Cys Tyr
(SEQ ID NO: 5185) Cys Glu Tyr Cys Tyr Asn Gly Ala Cys Thr Ala Cys Tyr
(SEQ ID NO: 5186) Cys Glu Tyr Cys Tyr Asn Gly Ala Cys Val Gly Cys Tyr
(SEQ ID NO: 5187) Cys Glu Tyr Cys Tyr Asn Gly Ala Cys Val Ala Cys Tyr
(SEQ ID NO: 5188) Cys Glu Tyr Cys Tyr Asn Gly Ala Cys Gly Gly Cys Tyr
(SEQ ID NO: 5189) Cys Glu Tyr Cys Tyr Asn Gly Ala Cys Gly Ala Cys Tyr
(SEQ ID NO: 5190) Cys Glu Tyr Cys Tyr Asn Gly Thr Cys Thr Gly Cys Tyr
(SEQ ID NO: 5191) Cys Glu Tyr Cys Tyr Asn Gly Thr Cys Thr Ala Cys Tyr
(SEQ ID NO: 5192) Cys Glu Tyr Cys Tyr Asn Gly Thr Cys Val Gly Cys Tyr
(SEQ ID NO: 5193) Cys Glu Tyr Cys Tyr Asn Gly Thr Cys Val Ala Cys Tyr

FIG. 3

| | |
|---|---|
| (SEQ ID NO: 5194) | Cys Glu Tyr Cys Tyr Asn Gly Thr Cys Gly Gly Cys Tyr |
| (SEQ ID NO: 5195) | Cys Glu Tyr Cys Tyr Asn Gly Thr Cys Gly Ala Cys Tyr |
| (SEQ ID NO: 5196) | Cys Glu Tyr Cys Val Asn Pro Ala Cys Thr Gly Cys Tyr |
| (SEQ ID NO: 5197) | Cys Glu Tyr Cys Val Asn Pro Ala Cys Thr Ala Cys Tyr |
| (SEQ ID NO: 5198) | Cys Glu Tyr Cys Val Asn Pro Ala Cys Val Gly Cys Tyr |
| (SEQ ID NO: 5199) | Cys Glu Tyr Cys Val Asn Pro Ala Cys Val Ala Cys Tyr |
| (SEQ ID NO: 5200) | Cys Glu Tyr Cys Val Asn Pro Ala Cys Gly Gly Cys Tyr |
| (SEQ ID NO: 5201) | Cys Glu Tyr Cys Val Asn Pro Ala Cys Gly Ala Cys Tyr |
| (SEQ ID NO: 5202) | Cys Glu Tyr Cys Val Asn Pro Thr Cys Thr Gly Cys Tyr |
| (SEQ ID NO: 5203) | Cys Glu Tyr Cys Val Asn Pro Thr Cys Thr Ala Cys Tyr |
| (SEQ ID NO: 5204) | Cys Glu Tyr Cys Val Asn Pro Thr Cys Val Gly Cys Tyr |
| (SEQ ID NO: 5205) | Cys Glu Tyr Cys Val Asn Pro Thr Cys Val Ala Cys Tyr |
| (SEQ ID NO: 5206) | Cys Glu Tyr Cys Val Asn Pro Thr Cys Gly Gly Cys Tyr |
| (SEQ ID NO: 5207) | Cys Glu Tyr Cys Val Asn Pro Thr Cys Gly Ala Cys Tyr |
| (SEQ ID NO: 5208) | Cys Glu Tyr Cys Val Asn Gly Ala Cys Thr Gly Cys Tyr |
| (SEQ ID NO: 5209) | Cys Glu Tyr Cys Val Asn Gly Ala Cys Thr Ala Cys Tyr |
| (SEQ ID NO: 5210) | Cys Glu Tyr Cys Val Asn Gly Ala Cys Val Gly Cys Tyr |
| (SEQ ID NO: 5211) | Cys Glu Tyr Cys Val Asn Gly Ala Cys Val Ala Cys Tyr |
| (SEQ ID NO: 5212) | Cys Glu Tyr Cys Val Asn Gly Ala Cys Gly Gly Cys Tyr |
| (SEQ ID NO: 5213) | Cys Glu Tyr Cys Val Asn Gly Ala Cys Gly Ala Cys Tyr |
| (SEQ ID NO: 5214) | Cys Glu Tyr Cys Val Asn Gly Thr Cys Thr Gly Cys Tyr |
| (SEQ ID NO: 5215) | Cys Glu Tyr Cys Val Asn Gly Thr Cys Thr Ala Cys Tyr |
| (SEQ ID NO: 5216) | Cys Glu Tyr Cys Val Asn Gly Thr Cys Val Gly Cys Tyr |
| (SEQ ID NO: 5217) | Cys Glu Tyr Cys Val Asn Gly Thr Cys Val Ala Cys Tyr |
| (SEQ ID NO: 5218) | Cys Glu Tyr Cys Val Asn Gly Thr Cys Gly Gly Cys Tyr |
| (SEQ ID NO: 5219) | Cys Glu Tyr Cys Val Asn Gly Thr Cys Gly Ala Cys Tyr |
| (SEQ ID NO: 5220) | Cys Glu Tyr Cys --- Asn Pro Ala Cys Thr Gly Cys Tyr |
| (SEQ ID NO: 5221) | Cys Glu Tyr Cys --- Asn Pro Ala Cys Thr Ala Cys Tyr |
| (SEQ ID NO: 5222) | Cys Glu Tyr Cys --- Asn Pro Ala Cys Val Gly Cys Tyr |
| (SEQ ID NO: 5223) | Cys Glu Tyr Cys --- Asn Pro Ala Cys Val Ala Cys Tyr |
| (SEQ ID NO: 5224) | Cys Glu Tyr Cys --- Asn Pro Ala Cys Gly Gly Cys Tyr |
| (SEQ ID NO: 5225) | Cys Glu Tyr Cys --- Asn Pro Ala Cys Gly Ala Cys Tyr |
| (SEQ ID NO: 5226) | Cys Glu Tyr Cys --- Asn Pro Thr Cys Thr Gly Cys Tyr |
| (SEQ ID NO: 5227) | Cys Glu Tyr Cys --- Asn Pro Thr Cys Thr Ala Cys Tyr |
| (SEQ ID NO: 5228) | Cys Glu Tyr Cys --- Asn Pro Thr Cys Val Gly Cys Tyr |
| (SEQ ID NO: 5229) | Cys Glu Tyr Cys --- Asn Pro Thr Cys Val Ala Cys Tyr |
| (SEQ ID NO: 5230) | Cys Glu Tyr Cys --- Asn Pro Thr Cys Gly Gly Cys Tyr |
| (SEQ ID NO: 5231) | Cys Glu Tyr Cys --- Asn Pro Thr Cys Gly Ala Cys Tyr |
| (SEQ ID NO: 5232) | Cys Glu Tyr Cys --- Asn Gly Ala Cys Thr Gly Cys Tyr |
| (SEQ ID NO: 5233) | Cys Glu Tyr Cys --- Asn Gly Ala Cys Thr Ala Cys Tyr |
| (SEQ ID NO: 5234) | Cys Glu Tyr Cys --- Asn Gly Ala Cys Val Gly Cys Tyr |
| (SEQ ID NO: 5235) | Cys Glu Tyr Cys --- Asn Gly Ala Cys Val Ala Cys Tyr |
| (SEQ ID NO: 5236) | Cys Glu Tyr Cys --- Asn Gly Ala Cys Gly Gly Cys Tyr |

FIG. 3

| | | |
|---|---|---|
| (SEQ ID NO: 5237) | Cys Glu Tyr Cys --- Asn Gly Ala Cys Gly Ala Cys Tyr |
| (SEQ ID NO: 5238) | Cys Glu Tyr Cys --- Asn Gly Thr Cys Thr Gly Cys Tyr |
| (SEQ ID NO: 5239) | Cys Glu Tyr Cys --- Asn Gly Thr Cys Thr Ala Cys Tyr |
| (SEQ ID NO: 5240) | Cys Glu Tyr Cys --- Asn Gly Thr Cys Val Gly Cys Tyr |
| (SEQ ID NO: 5241) | Cys Glu Tyr Cys --- Asn Gly Thr Cys Val Ala Cys Tyr |
| (SEQ ID NO: 5242) | Cys Glu Tyr Cys --- Asn Gly Thr Cys Gly Gly Cys Tyr |
| (SEQ ID NO: 5243) | Cys Glu Tyr Cys --- Asn Gly Thr Cys Gly Ala Cys Tyr |
| (SEQ ID NO: 5244) | Cys Glu Trp Cys Ala Asn Pro Ala Cys Thr Gly Cys Tyr |
| (SEQ ID NO: 5245) | Cys Glu Trp Cys Ala Asn Pro Ala Cys Thr Ala Cys Tyr |
| (SEQ ID NO: 5246) | Cys Glu Trp Cys Ala Asn Pro Ala Cys Val Gly Cys Tyr |
| (SEQ ID NO: 5247) | Cys Glu Trp Cys Ala Asn Pro Ala Cys Val Ala Cys Tyr |
| (SEQ ID NO: 5248) | Cys Glu Trp Cys Ala Asn Pro Ala Cys Gly Gly Cys Tyr |
| (SEQ ID NO: 5249) | Cys Glu Trp Cys Ala Asn Pro Ala Cys Gly Ala Cys Tyr |
| (SEQ ID NO: 5250) | Cys Glu Trp Cys Ala Asn Pro Thr Cys Thr Gly Cys Tyr |
| (SEQ ID NO: 5251) | Cys Glu Trp Cys Ala Asn Pro Thr Cys Thr Ala Cys Tyr |
| (SEQ ID NO: 5252) | Cys Glu Trp Cys Ala Asn Pro Thr Cys Val Gly Cys Tyr |
| (SEQ ID NO: 5253) | Cys Glu Trp Cys Ala Asn Pro Thr Cys Val Ala Cys Tyr |
| (SEQ ID NO: 5254) | Cys Glu Trp Cys Ala Asn Pro Thr Cys Gly Gly Cys Tyr |
| (SEQ ID NO: 5255) | Cys Glu Trp Cys Ala Asn Pro Thr Cys Gly Ala Cys Tyr |
| (SEQ ID NO: 5256) | Cys Glu Trp Cys Ala Asn Gly Ala Cys Thr Gly Cys Tyr |
| (SEQ ID NO: 5257) | Cys Glu Trp Cys Ala Asn Gly Ala Cys Thr Ala Cys Tyr |
| (SEQ ID NO: 5258) | Cys Glu Trp Cys Ala Asn Gly Ala Cys Val Gly Cys Tyr |
| (SEQ ID NO: 5259) | Cys Glu Trp Cys Ala Asn Gly Ala Cys Val Ala Cys Tyr |
| (SEQ ID NO: 5260) | Cys Glu Trp Cys Ala Asn Gly Ala Cys Gly Gly Cys Tyr |
| (SEQ ID NO: 5261) | Cys Glu Trp Cys Ala Asn Gly Ala Cys Gly Ala Cys Tyr |
| (SEQ ID NO: 5262) | Cys Glu Trp Cys Ala Asn Gly Thr Cys Thr Gly Cys Tyr |
| (SEQ ID NO: 5263) | Cys Glu Trp Cys Ala Asn Gly Thr Cys Thr Ala Cys Tyr |
| (SEQ ID NO: 5264) | Cys Glu Trp Cys Ala Asn Gly Thr Cys Val Gly Cys Tyr |
| (SEQ ID NO: 5265) | Cys Glu Trp Cys Ala Asn Gly Thr Cys Val Ala Cys Tyr |
| (SEQ ID NO: 5266) | Cys Glu Trp Cys Ala Asn Gly Thr Cys Gly Gly Cys Tyr |
| (SEQ ID NO: 5267) | Cys Glu Trp Cys Ala Asn Gly Thr Cys Gly Ala Cys Tyr |
| (SEQ ID NO: 5268) | Cys Glu Trp Cys Arg Asn Pro Ala Cys Thr Gly Cys Tyr |
| (SEQ ID NO: 5269) | Cys Glu Trp Cys Arg Asn Pro Ala Cys Thr Ala Cys Tyr |
| (SEQ ID NO: 5270) | Cys Glu Trp Cys Arg Asn Pro Ala Cys Val Gly Cys Tyr |
| (SEQ ID NO: 5271) | Cys Glu Trp Cys Arg Asn Pro Ala Cys Val Ala Cys Tyr |
| (SEQ ID NO: 5272) | Cys Glu Trp Cys Arg Asn Pro Ala Cys Gly Gly Cys Tyr |
| (SEQ ID NO: 5273) | Cys Glu Trp Cys Arg Asn Pro Ala Cys Gly Ala Cys Tyr |
| (SEQ ID NO: 5274) | Cys Glu Trp Cys Arg Asn Pro Thr Cys Thr Gly Cys Tyr |
| (SEQ ID NO: 5275) | Cys Glu Trp Cys Arg Asn Pro Thr Cys Thr Ala Cys Tyr |
| (SEQ ID NO: 5276) | Cys Glu Trp Cys Arg Asn Pro Thr Cys Val Gly Cys Tyr |
| (SEQ ID NO: 5277) | Cys Glu Trp Cys Arg Asn Pro Thr Cys Val Ala Cys Tyr |
| (SEQ ID NO: 5278) | Cys Glu Trp Cys Arg Asn Pro Thr Cys Gly Gly Cys Tyr |
| (SEQ ID NO: 5279) | Cys Glu Trp Cys Arg Asn Pro Thr Cys Gly Ala Cys Tyr |

FIG. 3

(SEQ ID NO: 5280)  Cys Glu Trp Cys Arg Asn Gly Ala Cys Thr Gly Cys Tyr
(SEQ ID NO: 5281)  Cys Glu Trp Cys Arg Asn Gly Ala Cys Thr Ala Cys Tyr
(SEQ ID NO: 5282)  Cys Glu Trp Cys Arg Asn Gly Ala Cys Val Gly Cys Tyr
(SEQ ID NO: 5283)  Cys Glu Trp Cys Arg Asn Gly Ala Cys Val Ala Cys Tyr
(SEQ ID NO: 5284)  Cys Glu Trp Cys Arg Asn Gly Ala Cys Gly Gly Cys Tyr
(SEQ ID NO: 5285)  Cys Glu Trp Cys Arg Asn Gly Ala Cys Gly Ala Cys Tyr
(SEQ ID NO: 5286)  Cys Glu Trp Cys Arg Asn Gly Thr Cys Thr Gly Cys Tyr
(SEQ ID NO: 5287)  Cys Glu Trp Cys Arg Asn Gly Thr Cys Thr Ala Cys Tyr
(SEQ ID NO: 5288)  Cys Glu Trp Cys Arg Asn Gly Thr Cys Val Gly Cys Tyr
(SEQ ID NO: 5289)  Cys Glu Trp Cys Arg Asn Gly Thr Cys Val Ala Cys Tyr
(SEQ ID NO: 5290)  Cys Glu Trp Cys Arg Asn Gly Thr Cys Gly Gly Cys Tyr
(SEQ ID NO: 5291)  Cys Glu Trp Cys Arg Asn Gly Thr Cys Gly Ala Cys Tyr
(SEQ ID NO: 5292)  Cys Glu Trp Cys Asn Asn Pro Ala Cys Thr Gly Cys Tyr
(SEQ ID NO: 5293)  Cys Glu Trp Cys Asn Asn Pro Ala Cys Thr Ala Cys Tyr
(SEQ ID NO: 5294)  Cys Glu Trp Cys Asn Asn Pro Ala Cys Val Gly Cys Tyr
(SEQ ID NO: 5295)  Cys Glu Trp Cys Asn Asn Pro Ala Cys Val Ala Cys Tyr
(SEQ ID NO: 5296)  Cys Glu Trp Cys Asn Asn Pro Ala Cys Gly Gly Cys Tyr
(SEQ ID NO: 5297)  Cys Glu Trp Cys Asn Asn Pro Ala Cys Gly Ala Cys Tyr
(SEQ ID NO: 5298)  Cys Glu Trp Cys Asn Asn Pro Thr Cys Thr Gly Cys Tyr
(SEQ ID NO: 5299)  Cys Glu Trp Cys Asn Asn Pro Thr Cys Thr Ala Cys Tyr
(SEQ ID NO: 5300)  Cys Glu Trp Cys Asn Asn Pro Thr Cys Val Gly Cys Tyr
(SEQ ID NO: 5301)  Cys Glu Trp Cys Asn Asn Pro Thr Cys Val Ala Cys Tyr
(SEQ ID NO: 5302)  Cys Glu Trp Cys Asn Asn Pro Thr Cys Gly Gly Cys Tyr
(SEQ ID NO: 5303)  Cys Glu Trp Cys Asn Asn Pro Thr Cys Gly Ala Cys Tyr
(SEQ ID NO: 5304)  Cys Glu Trp Cys Asn Asn Gly Ala Cys Thr Gly Cys Tyr
(SEQ ID NO: 5305)  Cys Glu Trp Cys Asn Asn Gly Ala Cys Thr Ala Cys Tyr
(SEQ ID NO: 5306)  Cys Glu Trp Cys Asn Asn Gly Ala Cys Val Gly Cys Tyr
(SEQ ID NO: 5307)  Cys Glu Trp Cys Asn Asn Gly Ala Cys Val Ala Cys Tyr
(SEQ ID NO: 5308)  Cys Glu Trp Cys Asn Asn Gly Ala Cys Gly Gly Cys Tyr
(SEQ ID NO: 5309)  Cys Glu Trp Cys Asn Asn Gly Ala Cys Gly Ala Cys Tyr
(SEQ ID NO: 5310)  Cys Glu Trp Cys Asn Asn Gly Thr Cys Thr Gly Cys Tyr
(SEQ ID NO: 5311)  Cys Glu Trp Cys Asn Asn Gly Thr Cys Thr Ala Cys Tyr
(SEQ ID NO: 5312)  Cys Glu Trp Cys Asn Asn Gly Thr Cys Val Gly Cys Tyr
(SEQ ID NO: 5313)  Cys Glu Trp Cys Asn Asn Gly Thr Cys Val Ala Cys Tyr
(SEQ ID NO: 5314)  Cys Glu Trp Cys Asn Asn Gly Thr Cys Gly Gly Cys Tyr
(SEQ ID NO: 5315)  Cys Glu Trp Cys Asn Asn Gly Thr Cys Gly Ala Cys Tyr
(SEQ ID NO: 5316)  Cys Glu Trp Cys Asp Asn Pro Ala Cys Thr Gly Cys Tyr
(SEQ ID NO: 5317)  Cys Glu Trp Cys Asp Asn Pro Ala Cys Thr Ala Cys Tyr
(SEQ ID NO: 5318)  Cys Glu Trp Cys Asp Asn Pro Ala Cys Val Gly Cys Tyr
(SEQ ID NO: 5319)  Cys Glu Trp Cys Asp Asn Pro Ala Cys Val Ala Cys Tyr
(SEQ ID NO: 5320)  Cys Glu Trp Cys Asp Asn Pro Ala Cys Gly Gly Cys Tyr
(SEQ ID NO: 5321)  Cys Glu Trp Cys Asp Asn Pro Ala Cys Gly Ala Cys Tyr
(SEQ ID NO: 5322)  Cys Glu Trp Cys Asp Asn Pro Thr Cys Thr Gly Cys Tyr

FIG. 3

(SEQ ID NO: 5323) Cys Glu Trp Cys Asp Asn Pro Thr Cys Thr Ala Cys Tyr
(SEQ ID NO: 5324) Cys Glu Trp Cys Asp Asn Pro Thr Cys Val Gly Cys Tyr
(SEQ ID NO: 5325) Cys Glu Trp Cys Asp Asn Pro Thr Cys Val Ala Cys Tyr
(SEQ ID NO: 5326) Cys Glu Trp Cys Asp Asn Pro Thr Cys Gly Gly Cys Tyr
(SEQ ID NO: 5327) Cys Glu Trp Cys Asp Asn Pro Thr Cys Gly Ala Cys Tyr
(SEQ ID NO: 5328) Cys Glu Trp Cys Asp Asn Gly Ala Cys Thr Gly Cys Tyr
(SEQ ID NO: 5329) Cys Glu Trp Cys Asp Asn Gly Ala Cys Thr Ala Cys Tyr
(SEQ ID NO: 5330) Cys Glu Trp Cys Asp Asn Gly Ala Cys Val Gly Cys Tyr
(SEQ ID NO: 5331) Cys Glu Trp Cys Asp Asn Gly Ala Cys Val Ala Cys Tyr
(SEQ ID NO: 5332) Cys Glu Trp Cys Asp Asn Gly Ala Cys Gly Gly Cys Tyr
(SEQ ID NO: 5333) Cys Glu Trp Cys Asp Asn Gly Ala Cys Gly Ala Cys Tyr
(SEQ ID NO: 5334) Cys Glu Trp Cys Asp Asn Gly Thr Cys Thr Gly Cys Tyr
(SEQ ID NO: 5335) Cys Glu Trp Cys Asp Asn Gly Thr Cys Thr Ala Cys Tyr
(SEQ ID NO: 5336) Cys Glu Trp Cys Asp Asn Gly Thr Cys Val Gly Cys Tyr
(SEQ ID NO: 5337) Cys Glu Trp Cys Asp Asn Gly Thr Cys Val Ala Cys Tyr
(SEQ ID NO: 5338) Cys Glu Trp Cys Asp Asn Gly Thr Cys Gly Gly Cys Tyr
(SEQ ID NO: 5339) Cys Glu Trp Cys Asp Asn Gly Thr Cys Gly Ala Cys Tyr
(SEQ ID NO: 5340) Cys Glu Trp Cys Gln Asn Pro Ala Cys Thr Gly Cys Tyr
(SEQ ID NO: 5341) Cys Glu Trp Cys Gln Asn Pro Ala Cys Thr Ala Cys Tyr
(SEQ ID NO: 5342) Cys Glu Trp Cys Gln Asn Pro Ala Cys Val Gly Cys Tyr
(SEQ ID NO: 5343) Cys Glu Trp Cys Gln Asn Pro Ala Cys Val Ala Cys Tyr
(SEQ ID NO: 5344) Cys Glu Trp Cys Gln Asn Pro Ala Cys Gly Gly Cys Tyr
(SEQ ID NO: 5345) Cys Glu Trp Cys Gln Asn Pro Ala Cys Gly Ala Cys Tyr
(SEQ ID NO: 5346) Cys Glu Trp Cys Gln Asn Pro Thr Cys Thr Gly Cys Tyr
(SEQ ID NO: 5347) Cys Glu Trp Cys Gln Asn Pro Thr Cys Thr Ala Cys Tyr
(SEQ ID NO: 5348) Cys Glu Trp Cys Gln Asn Pro Thr Cys Val Gly Cys Tyr
(SEQ ID NO: 5349) Cys Glu Trp Cys Gln Asn Pro Thr Cys Val Ala Cys Tyr
(SEQ ID NO: 5350) Cys Glu Trp Cys Gln Asn Pro Thr Cys Gly Gly Cys Tyr
(SEQ ID NO: 5351) Cys Glu Trp Cys Gln Asn Pro Thr Cys Gly Ala Cys Tyr
(SEQ ID NO: 5352) Cys Glu Trp Cys Gln Asn Gly Ala Cys Thr Gly Cys Tyr
(SEQ ID NO: 5353) Cys Glu Trp Cys Gln Asn Gly Ala Cys Thr Ala Cys Tyr
(SEQ ID NO: 5354) Cys Glu Trp Cys Gln Asn Gly Ala Cys Val Gly Cys Tyr
(SEQ ID NO: 5355) Cys Glu Trp Cys Gln Asn Gly Ala Cys Val Ala Cys Tyr
(SEQ ID NO: 5356) Cys Glu Trp Cys Gln Asn Gly Ala Cys Gly Gly Cys Tyr
(SEQ ID NO: 5357) Cys Glu Trp Cys Gln Asn Gly Ala Cys Gly Ala Cys Tyr
(SEQ ID NO: 5358) Cys Glu Trp Cys Gln Asn Gly Thr Cys Thr Gly Cys Tyr
(SEQ ID NO: 5359) Cys Glu Trp Cys Gln Asn Gly Thr Cys Thr Ala Cys Tyr
(SEQ ID NO: 5360) Cys Glu Trp Cys Gln Asn Gly Thr Cys Val Gly Cys Tyr
(SEQ ID NO: 5361) Cys Glu Trp Cys Gln Asn Gly Thr Cys Val Ala Cys Tyr
(SEQ ID NO: 5362) Cys Glu Trp Cys Gln Asn Gly Thr Cys Gly Gly Cys Tyr
(SEQ ID NO: 5363) Cys Glu Trp Cys Gln Asn Gly Thr Cys Gly Ala Cys Tyr
(SEQ ID NO: 5364) Cys Glu Trp Cys Glu Asn Pro Ala Cys Thr Gly Cys Tyr
(SEQ ID NO: 5365) Cys Glu Trp Cys Glu Asn Pro Ala Cys Thr Ala Cys Tyr

FIG. 3

(SEQ ID NO: 5366)   Cys Glu Trp Cys Glu Asn Pro Ala Cys Val Gly Cys Tyr
(SEQ ID NO: 5367)   Cys Glu Trp Cys Glu Asn Pro Ala Cys Val Ala Cys Tyr
(SEQ ID NO: 5368)   Cys Glu Trp Cys Glu Asn Pro Ala Cys Gly Gly Cys Tyr
(SEQ ID NO: 5369)   Cys Glu Trp Cys Glu Asn Pro Ala Cys Gly Ala Cys Tyr
(SEQ ID NO: 5370)   Cys Glu Trp Cys Glu Asn Pro Thr Cys Thr Gly Cys Tyr
(SEQ ID NO: 5371)   Cys Glu Trp Cys Glu Asn Pro Thr Cys Thr Ala Cys Tyr
(SEQ ID NO: 5372)   Cys Glu Trp Cys Glu Asn Pro Thr Cys Val Gly Cys Tyr
(SEQ ID NO: 5373)   Cys Glu Trp Cys Glu Asn Pro Thr Cys Val Ala Cys Tyr
(SEQ ID NO: 5374)   Cys Glu Trp Cys Glu Asn Pro Thr Cys Gly Gly Cys Tyr
(SEQ ID NO: 5375)   Cys Glu Trp Cys Glu Asn Pro Thr Cys Gly Ala Cys Tyr
(SEQ ID NO: 5376)   Cys Glu Trp Cys Glu Asn Gly Ala Cys Thr Gly Cys Tyr
(SEQ ID NO: 5377)   Cys Glu Trp Cys Glu Asn Gly Ala Cys Thr Ala Cys Tyr
(SEQ ID NO: 5378)   Cys Glu Trp Cys Glu Asn Gly Ala Cys Val Gly Cys Tyr
(SEQ ID NO: 5379)   Cys Glu Trp Cys Glu Asn Gly Ala Cys Val Ala Cys Tyr
(SEQ ID NO: 5380)   Cys Glu Trp Cys Glu Asn Gly Ala Cys Gly Gly Cys Tyr
(SEQ ID NO: 5381)   Cys Glu Trp Cys Glu Asn Gly Ala Cys Gly Ala Cys Tyr
(SEQ ID NO: 5382)   Cys Glu Trp Cys Glu Asn Gly Thr Cys Thr Gly Cys Tyr
(SEQ ID NO: 5383)   Cys Glu Trp Cys Glu Asn Gly Thr Cys Thr Ala Cys Tyr
(SEQ ID NO: 5384)   Cys Glu Trp Cys Glu Asn Gly Thr Cys Val Gly Cys Tyr
(SEQ ID NO: 5385)   Cys Glu Trp Cys Glu Asn Gly Thr Cys Val Ala Cys Tyr
(SEQ ID NO: 5386)   Cys Glu Trp Cys Glu Asn Gly Thr Cys Gly Gly Cys Tyr
(SEQ ID NO: 5387)   Cys Glu Trp Cys Glu Asn Gly Thr Cys Gly Ala Cys Tyr
(SEQ ID NO: 5388)   Cys Glu Trp Cys Gly Asn Pro Ala Cys Thr Gly Cys Tyr
(SEQ ID NO: 5389)   Cys Glu Trp Cys Gly Asn Pro Ala Cys Thr Ala Cys Tyr
(SEQ ID NO: 5390)   Cys Glu Trp Cys Gly Asn Pro Ala Cys Val Gly Cys Tyr
(SEQ ID NO: 5391)   Cys Glu Trp Cys Gly Asn Pro Ala Cys Val Ala Cys Tyr
(SEQ ID NO: 5392)   Cys Glu Trp Cys Gly Asn Pro Ala Cys Gly Gly Cys Tyr
(SEQ ID NO: 5393)   Cys Glu Trp Cys Gly Asn Pro Ala Cys Gly Ala Cys Tyr
(SEQ ID NO: 5394)   Cys Glu Trp Cys Gly Asn Pro Thr Cys Thr Gly Cys Tyr
(SEQ ID NO: 5395)   Cys Glu Trp Cys Gly Asn Pro Thr Cys Thr Ala Cys Tyr
(SEQ ID NO: 5396)   Cys Glu Trp Cys Gly Asn Pro Thr Cys Val Gly Cys Tyr
(SEQ ID NO: 5397)   Cys Glu Trp Cys Gly Asn Pro Thr Cys Val Ala Cys Tyr
(SEQ ID NO: 5398)   Cys Glu Trp Cys Gly Asn Pro Thr Cys Gly Gly Cys Tyr
(SEQ ID NO: 5399)   Cys Glu Trp Cys Gly Asn Pro Thr Cys Gly Ala Cys Tyr
(SEQ ID NO: 5400)   Cys Glu Trp Cys Gly Asn Gly Ala Cys Thr Gly Cys Tyr
(SEQ ID NO: 5401)   Cys Glu Trp Cys Gly Asn Gly Ala Cys Thr Ala Cys Tyr
(SEQ ID NO: 5402)   Cys Glu Trp Cys Gly Asn Gly Ala Cys Val Gly Cys Tyr
(SEQ ID NO: 5403)   Cys Glu Trp Cys Gly Asn Gly Ala Cys Val Ala Cys Tyr
(SEQ ID NO: 5404)   Cys Glu Trp Cys Gly Asn Gly Ala Cys Gly Gly Cys Tyr
(SEQ ID NO: 5405)   Cys Glu Trp Cys Gly Asn Gly Ala Cys Gly Ala Cys Tyr
(SEQ ID NO: 5406)   Cys Glu Trp Cys Gly Asn Gly Thr Cys Thr Gly Cys Tyr
(SEQ ID NO: 5407)   Cys Glu Trp Cys Gly Asn Gly Thr Cys Thr Ala Cys Tyr
(SEQ ID NO: 5408)   Cys Glu Trp Cys Gly Asn Gly Thr Cys Val Gly Cys Tyr

FIG. 3

(SEQ ID NO: 5409)  Cys Glu Trp Cys Gly Asn Gly Thr Cys Val Ala Cys Tyr
(SEQ ID NO: 5410)  Cys Glu Trp Cys Gly Asn Gly Thr Cys Gly Gly Cys Tyr
(SEQ ID NO: 5411)  Cys Glu Trp Cys Gly Asn Gly Thr Cys Gly Ala Cys Tyr
(SEQ ID NO: 5412)  Cys Glu Trp Cys His Asn Pro Ala Cys Thr Gly Cys Tyr
(SEQ ID NO: 5413)  Cys Glu Trp Cys His Asn Pro Ala Cys Thr Ala Cys Tyr
(SEQ ID NO: 5414)  Cys Glu Trp Cys His Asn Pro Ala Cys Val Gly Cys Tyr
(SEQ ID NO: 5415)  Cys Glu Trp Cys His Asn Pro Ala Cys Val Ala Cys Tyr
(SEQ ID NO: 5416)  Cys Glu Trp Cys His Asn Pro Ala Cys Gly Gly Cys Tyr
(SEQ ID NO: 5417)  Cys Glu Trp Cys His Asn Pro Ala Cys Gly Ala Cys Tyr
(SEQ ID NO: 5418)  Cys Glu Trp Cys His Asn Pro Thr Cys Thr Gly Cys Tyr
(SEQ ID NO: 5419)  Cys Glu Trp Cys His Asn Pro Thr Cys Thr Ala Cys Tyr
(SEQ ID NO: 5420)  Cys Glu Trp Cys His Asn Pro Thr Cys Val Gly Cys Tyr
(SEQ ID NO: 5421)  Cys Glu Trp Cys His Asn Pro Thr Cys Val Ala Cys Tyr
(SEQ ID NO: 5422)  Cys Glu Trp Cys His Asn Pro Thr Cys Gly Gly Cys Tyr
(SEQ ID NO: 5423)  Cys Glu Trp Cys His Asn Pro Thr Cys Gly Ala Cys Tyr
(SEQ ID NO: 5424)  Cys Glu Trp Cys His Asn Gly Ala Cys Thr Gly Cys Tyr
(SEQ ID NO: 5425)  Cys Glu Trp Cys His Asn Gly Ala Cys Thr Ala Cys Tyr
(SEQ ID NO: 5426)  Cys Glu Trp Cys His Asn Gly Ala Cys Val Gly Cys Tyr
(SEQ ID NO: 5427)  Cys Glu Trp Cys His Asn Gly Ala Cys Val Ala Cys Tyr
(SEQ ID NO: 5428)  Cys Glu Trp Cys His Asn Gly Ala Cys Gly Gly Cys Tyr
(SEQ ID NO: 5429)  Cys Glu Trp Cys His Asn Gly Ala Cys Gly Ala Cys Tyr
(SEQ ID NO: 5430)  Cys Glu Trp Cys His Asn Gly Thr Cys Thr Gly Cys Tyr
(SEQ ID NO: 5431)  Cys Glu Trp Cys His Asn Gly Thr Cys Thr Ala Cys Tyr
(SEQ ID NO: 5432)  Cys Glu Trp Cys His Asn Gly Thr Cys Val Gly Cys Tyr
(SEQ ID NO: 5433)  Cys Glu Trp Cys His Asn Gly Thr Cys Val Ala Cys Tyr
(SEQ ID NO: 5434)  Cys Glu Trp Cys His Asn Gly Thr Cys Gly Gly Cys Tyr
(SEQ ID NO: 5435)  Cys Glu Trp Cys His Asn Gly Thr Cys Gly Ala Cys Tyr
(SEQ ID NO: 5436)  Cys Glu Trp Cys Ile Asn Pro Ala Cys Thr Gly Cys Tyr
(SEQ ID NO: 5437)  Cys Glu Trp Cys Ile Asn Pro Ala Cys Thr Ala Cys Tyr
(SEQ ID NO: 5438)  Cys Glu Trp Cys Ile Asn Pro Ala Cys Val Gly Cys Tyr
(SEQ ID NO: 5439)  Cys Glu Trp Cys Ile Asn Pro Ala Cys Val Ala Cys Tyr
(SEQ ID NO: 5440)  Cys Glu Trp Cys Ile Asn Pro Ala Cys Gly Gly Cys Tyr
(SEQ ID NO: 5441)  Cys Glu Trp Cys Ile Asn Pro Ala Cys Gly Ala Cys Tyr
(SEQ ID NO: 5442)  Cys Glu Trp Cys Ile Asn Pro Thr Cys Thr Gly Cys Tyr
(SEQ ID NO: 5443)  Cys Glu Trp Cys Ile Asn Pro Thr Cys Thr Ala Cys Tyr
(SEQ ID NO: 5444)  Cys Glu Trp Cys Ile Asn Pro Thr Cys Val Gly Cys Tyr
(SEQ ID NO: 5445)  Cys Glu Trp Cys Ile Asn Pro Thr Cys Val Ala Cys Tyr
(SEQ ID NO: 5446)  Cys Glu Trp Cys Ile Asn Pro Thr Cys Gly Gly Cys Tyr
(SEQ ID NO: 5447)  Cys Glu Trp Cys Ile Asn Pro Thr Cys Gly Ala Cys Tyr
(SEQ ID NO: 5448)  Cys Glu Trp Cys Ile Asn Gly Ala Cys Thr Gly Cys Tyr
(SEQ ID NO: 5449)  Cys Glu Trp Cys Ile Asn Gly Ala Cys Thr Ala Cys Tyr
(SEQ ID NO: 5450)  Cys Glu Trp Cys Ile Asn Gly Ala Cys Val Gly Cys Tyr
(SEQ ID NO: 5451)  Cys Glu Trp Cys Ile Asn Gly Ala Cys Val Ala Cys Tyr

FIG. 3

| | |
|---|---|
| (SEQ ID NO: 5452) | Cys Glu Trp Cys Ile Asn Gly Ala Cys Gly Gly Cys Tyr |
| (SEQ ID NO: 5453) | Cys Glu Trp Cys Ile Asn Gly Ala Cys Gly Ala Cys Tyr |
| (SEQ ID NO: 5454) | Cys Glu Trp Cys Ile Asn Gly Thr Cys Thr Gly Cys Tyr |
| (SEQ ID NO: 5455) | Cys Glu Trp Cys Ile Asn Gly Thr Cys Thr Ala Cys Tyr |
| (SEQ ID NO: 5456) | Cys Glu Trp Cys Ile Asn Gly Thr Cys Val Gly Cys Tyr |
| (SEQ ID NO: 5457) | Cys Glu Trp Cys Ile Asn Gly Thr Cys Val Ala Cys Tyr |
| (SEQ ID NO: 5458) | Cys Glu Trp Cys Ile Asn Gly Thr Cys Gly Gly Cys Tyr |
| (SEQ ID NO: 5459) | Cys Glu Trp Cys Ile Asn Gly Thr Cys Gly Ala Cys Tyr |
| (SEQ ID NO: 5460) | Cys Glu Trp Cys Leu Asn Pro Ala Cys Thr Gly Cys Tyr |
| (SEQ ID NO: 5461) | Cys Glu Trp Cys Leu Asn Pro Ala Cys Thr Ala Cys Tyr |
| (SEQ ID NO: 5462) | Cys Glu Trp Cys Leu Asn Pro Ala Cys Val Gly Cys Tyr |
| (SEQ ID NO: 5463) | Cys Glu Trp Cys Leu Asn Pro Ala Cys Val Ala Cys Tyr |
| (SEQ ID NO: 5464) | Cys Glu Trp Cys Leu Asn Pro Ala Cys Gly Gly Cys Tyr |
| (SEQ ID NO: 5465) | Cys Glu Trp Cys Leu Asn Pro Ala Cys Gly Ala Cys Tyr |
| (SEQ ID NO: 5466) | Cys Glu Trp Cys Leu Asn Pro Thr Cys Thr Gly Cys Tyr |
| (SEQ ID NO: 5467) | Cys Glu Trp Cys Leu Asn Pro Thr Cys Thr Ala Cys Tyr |
| (SEQ ID NO: 5468) | Cys Glu Trp Cys Leu Asn Pro Thr Cys Val Gly Cys Tyr |
| (SEQ ID NO: 5469) | Cys Glu Trp Cys Leu Asn Pro Thr Cys Val Ala Cys Tyr |
| (SEQ ID NO: 5470) | Cys Glu Trp Cys Leu Asn Pro Thr Cys Gly Gly Cys Tyr |
| (SEQ ID NO: 5471) | Cys Glu Trp Cys Leu Asn Pro Thr Cys Gly Ala Cys Tyr |
| (SEQ ID NO: 5472) | Cys Glu Trp Cys Leu Asn Gly Ala Cys Thr Gly Cys Tyr |
| (SEQ ID NO: 5473) | Cys Glu Trp Cys Leu Asn Gly Ala Cys Thr Ala Cys Tyr |
| (SEQ ID NO: 5474) | Cys Glu Trp Cys Leu Asn Gly Ala Cys Val Gly Cys Tyr |
| (SEQ ID NO: 5475) | Cys Glu Trp Cys Leu Asn Gly Ala Cys Val Ala Cys Tyr |
| (SEQ ID NO: 5476) | Cys Glu Trp Cys Leu Asn Gly Ala Cys Gly Gly Cys Tyr |
| (SEQ ID NO: 5477) | Cys Glu Trp Cys Leu Asn Gly Ala Cys Gly Ala Cys Tyr |
| (SEQ ID NO: 5478) | Cys Glu Trp Cys Leu Asn Gly Thr Cys Thr Gly Cys Tyr |
| (SEQ ID NO: 5479) | Cys Glu Trp Cys Leu Asn Gly Thr Cys Thr Ala Cys Tyr |
| (SEQ ID NO: 5480) | Cys Glu Trp Cys Leu Asn Gly Thr Cys Val Gly Cys Tyr |
| (SEQ ID NO: 5481) | Cys Glu Trp Cys Leu Asn Gly Thr Cys Val Ala Cys Tyr |
| (SEQ ID NO: 5482) | Cys Glu Trp Cys Leu Asn Gly Thr Cys Gly Gly Cys Tyr |
| (SEQ ID NO: 5483) | Cys Glu Trp Cys Leu Asn Gly Thr Cys Gly Ala Cys Tyr |
| (SEQ ID NO: 5484) | Cys Glu Trp Cys Lys Asn Pro Ala Cys Thr Gly Cys Tyr |
| (SEQ ID NO: 5485) | Cys Glu Trp Cys Lys Asn Pro Ala Cys Thr Ala Cys Tyr |
| (SEQ ID NO: 5486) | Cys Glu Trp Cys Lys Asn Pro Ala Cys Val Gly Cys Tyr |
| (SEQ ID NO: 5487) | Cys Glu Trp Cys Lys Asn Pro Ala Cys Val Ala Cys Tyr |
| (SEQ ID NO: 5488) | Cys Glu Trp Cys Lys Asn Pro Ala Cys Gly Gly Cys Tyr |
| (SEQ ID NO: 5489) | Cys Glu Trp Cys Lys Asn Pro Ala Cys Gly Ala Cys Tyr |
| (SEQ ID NO: 5490) | Cys Glu Trp Cys Lys Asn Pro Thr Cys Thr Gly Cys Tyr |
| (SEQ ID NO: 5491) | Cys Glu Trp Cys Lys Asn Pro Thr Cys Thr Ala Cys Tyr |
| (SEQ ID NO: 5492) | Cys Glu Trp Cys Lys Asn Pro Thr Cys Val Gly Cys Tyr |
| (SEQ ID NO: 5493) | Cys Glu Trp Cys Lys Asn Pro Thr Cys Val Ala Cys Tyr |
| (SEQ ID NO: 5494) | Cys Glu Trp Cys Lys Asn Pro Thr Cys Gly Gly Cys Tyr |

FIG. 3

(SEQ ID NO: 5495) Cys Glu Trp Cys Lys Asn Pro Thr Cys Gly Ala Cys Tyr
(SEQ ID NO: 5496) Cys Glu Trp Cys Lys Asn Gly Ala Cys Thr Gly Cys Tyr
(SEQ ID NO: 5497) Cys Glu Trp Cys Lys Asn Gly Ala Cys Thr Ala Cys Tyr
(SEQ ID NO: 5498) Cys Glu Trp Cys Lys Asn Gly Ala Cys Val Gly Cys Tyr
(SEQ ID NO: 5499) Cys Glu Trp Cys Lys Asn Gly Ala Cys Val Ala Cys Tyr
(SEQ ID NO: 5500) Cys Glu Trp Cys Lys Asn Gly Ala Cys Gly Gly Cys Tyr
(SEQ ID NO: 5501) Cys Glu Trp Cys Lys Asn Gly Ala Cys Gly Ala Cys Tyr
(SEQ ID NO: 5502) Cys Glu Trp Cys Lys Asn Gly Thr Cys Thr Gly Cys Tyr
(SEQ ID NO: 5503) Cys Glu Trp Cys Lys Asn Gly Thr Cys Thr Ala Cys Tyr
(SEQ ID NO: 5504) Cys Glu Trp Cys Lys Asn Gly Thr Cys Val Gly Cys Tyr
(SEQ ID NO: 5505) Cys Glu Trp Cys Lys Asn Gly Thr Cys Val Ala Cys Tyr
(SEQ ID NO: 5506) Cys Glu Trp Cys Lys Asn Gly Thr Cys Gly Gly Cys Tyr
(SEQ ID NO: 5507) Cys Glu Trp Cys Lys Asn Gly Thr Cys Gly Ala Cys Tyr
(SEQ ID NO: 5508) Cys Glu Trp Cys Met Asn Pro Ala Cys Thr Gly Cys Tyr
(SEQ ID NO: 5509) Cys Glu Trp Cys Met Asn Pro Ala Cys Thr Ala Cys Tyr
(SEQ ID NO: 5510) Cys Glu Trp Cys Met Asn Pro Ala Cys Val Gly Cys Tyr
(SEQ ID NO: 5511) Cys Glu Trp Cys Met Asn Pro Ala Cys Val Ala Cys Tyr
(SEQ ID NO: 5512) Cys Glu Trp Cys Met Asn Pro Ala Cys Gly Gly Cys Tyr
(SEQ ID NO: 5513) Cys Glu Trp Cys Met Asn Pro Ala Cys Gly Ala Cys Tyr
(SEQ ID NO: 5514) Cys Glu Trp Cys Met Asn Pro Thr Cys Thr Gly Cys Tyr
(SEQ ID NO: 5515) Cys Glu Trp Cys Met Asn Pro Thr Cys Thr Ala Cys Tyr
(SEQ ID NO: 5516) Cys Glu Trp Cys Met Asn Pro Thr Cys Val Gly Cys Tyr
(SEQ ID NO: 5517) Cys Glu Trp Cys Met Asn Pro Thr Cys Val Ala Cys Tyr
(SEQ ID NO: 5518) Cys Glu Trp Cys Met Asn Pro Thr Cys Gly Gly Cys Tyr
(SEQ ID NO: 5519) Cys Glu Trp Cys Met Asn Pro Thr Cys Gly Ala Cys Tyr
(SEQ ID NO: 5520) Cys Glu Trp Cys Met Asn Gly Ala Cys Thr Gly Cys Tyr
(SEQ ID NO: 5521) Cys Glu Trp Cys Met Asn Gly Ala Cys Thr Ala Cys Tyr
(SEQ ID NO: 5522) Cys Glu Trp Cys Met Asn Gly Ala Cys Val Gly Cys Tyr
(SEQ ID NO: 5523) Cys Glu Trp Cys Met Asn Gly Ala Cys Val Ala Cys Tyr
(SEQ ID NO: 5524) Cys Glu Trp Cys Met Asn Gly Ala Cys Gly Gly Cys Tyr
(SEQ ID NO: 5525) Cys Glu Trp Cys Met Asn Gly Ala Cys Gly Ala Cys Tyr
(SEQ ID NO: 5526) Cys Glu Trp Cys Met Asn Gly Thr Cys Thr Gly Cys Tyr
(SEQ ID NO: 5527) Cys Glu Trp Cys Met Asn Gly Thr Cys Thr Ala Cys Tyr
(SEQ ID NO: 5528) Cys Glu Trp Cys Met Asn Gly Thr Cys Val Gly Cys Tyr
(SEQ ID NO: 5529) Cys Glu Trp Cys Met Asn Gly Thr Cys Val Ala Cys Tyr
(SEQ ID NO: 5530) Cys Glu Trp Cys Met Asn Gly Thr Cys Gly Gly Cys Tyr
(SEQ ID NO: 5531) Cys Glu Trp Cys Met Asn Gly Thr Cys Gly Ala Cys Tyr
(SEQ ID NO: 5532) Cys Glu Trp Cys Phe Asn Pro Ala Cys Thr Gly Cys Tyr
(SEQ ID NO: 5533) Cys Glu Trp Cys Phe Asn Pro Ala Cys Thr Ala Cys Tyr
(SEQ ID NO: 5534) Cys Glu Trp Cys Phe Asn Pro Ala Cys Val Gly Cys Tyr
(SEQ ID NO: 5535) Cys Glu Trp Cys Phe Asn Pro Ala Cys Val Ala Cys Tyr
(SEQ ID NO: 5536) Cys Glu Trp Cys Phe Asn Pro Ala Cys Gly Gly Cys Tyr
(SEQ ID NO: 5537) Cys Glu Trp Cys Phe Asn Pro Ala Cys Gly Ala Cys Tyr

FIG. 3

| | |
|---|---|
| (SEQ ID NO: 5538) | Cys Glu Trp Cys Phe Asn Pro Thr Cys Thr Gly Cys Tyr |
| (SEQ ID NO: 5539) | Cys Glu Trp Cys Phe Asn Pro Thr Cys Thr Ala Cys Tyr |
| (SEQ ID NO: 5540) | Cys Glu Trp Cys Phe Asn Pro Thr Cys Val Gly Cys Tyr |
| (SEQ ID NO: 5541) | Cys Glu Trp Cys Phe Asn Pro Thr Cys Val Ala Cys Tyr |
| (SEQ ID NO: 5542) | Cys Glu Trp Cys Phe Asn Pro Thr Cys Gly Gly Cys Tyr |
| (SEQ ID NO: 5543) | Cys Glu Trp Cys Phe Asn Pro Thr Cys Gly Ala Cys Tyr |
| (SEQ ID NO: 5544) | Cys Glu Trp Cys Phe Asn Gly Ala Cys Thr Gly Cys Tyr |
| (SEQ ID NO: 5545) | Cys Glu Trp Cys Phe Asn Gly Ala Cys Thr Ala Cys Tyr |
| (SEQ ID NO: 5546) | Cys Glu Trp Cys Phe Asn Gly Ala Cys Val Gly Cys Tyr |
| (SEQ ID NO: 5547) | Cys Glu Trp Cys Phe Asn Gly Ala Cys Val Ala Cys Tyr |
| (SEQ ID NO: 5548) | Cys Glu Trp Cys Phe Asn Gly Ala Cys Gly Gly Cys Tyr |
| (SEQ ID NO: 5549) | Cys Glu Trp Cys Phe Asn Gly Ala Cys Gly Ala Cys Tyr |
| (SEQ ID NO: 5550) | Cys Glu Trp Cys Phe Asn Gly Thr Cys Thr Gly Cys Tyr |
| (SEQ ID NO: 5551) | Cys Glu Trp Cys Phe Asn Gly Thr Cys Thr Ala Cys Tyr |
| (SEQ ID NO: 5552) | Cys Glu Trp Cys Phe Asn Gly Thr Cys Val Gly Cys Tyr |
| (SEQ ID NO: 5553) | Cys Glu Trp Cys Phe Asn Gly Thr Cys Val Ala Cys Tyr |
| (SEQ ID NO: 5554) | Cys Glu Trp Cys Phe Asn Gly Thr Cys Gly Gly Cys Tyr |
| (SEQ ID NO: 5555) | Cys Glu Trp Cys Phe Asn Gly Thr Cys Gly Ala Cys Tyr |
| (SEQ ID NO: 5556) | Cys Glu Trp Cys Pro Asn Pro Ala Cys Thr Gly Cys Tyr |
| (SEQ ID NO: 5557) | Cys Glu Trp Cys Pro Asn Pro Ala Cys Thr Ala Cys Tyr |
| (SEQ ID NO: 5558) | Cys Glu Trp Cys Pro Asn Pro Ala Cys Val Gly Cys Tyr |
| (SEQ ID NO: 5559) | Cys Glu Trp Cys Pro Asn Pro Ala Cys Val Ala Cys Tyr |
| (SEQ ID NO: 5560) | Cys Glu Trp Cys Pro Asn Pro Ala Cys Gly Gly Cys Tyr |
| (SEQ ID NO: 5561) | Cys Glu Trp Cys Pro Asn Pro Ala Cys Gly Ala Cys Tyr |
| (SEQ ID NO: 5562) | Cys Glu Trp Cys Pro Asn Pro Thr Cys Thr Gly Cys Tyr |
| (SEQ ID NO: 5563) | Cys Glu Trp Cys Pro Asn Pro Thr Cys Thr Ala Cys Tyr |
| (SEQ ID NO: 5564) | Cys Glu Trp Cys Pro Asn Pro Thr Cys Val Gly Cys Tyr |
| (SEQ ID NO: 5565) | Cys Glu Trp Cys Pro Asn Pro Thr Cys Val Ala Cys Tyr |
| (SEQ ID NO: 5566) | Cys Glu Trp Cys Pro Asn Pro Thr Cys Gly Gly Cys Tyr |
| (SEQ ID NO: 5567) | Cys Glu Trp Cys Pro Asn Pro Thr Cys Gly Ala Cys Tyr |
| (SEQ ID NO: 5568) | Cys Glu Trp Cys Pro Asn Gly Ala Cys Thr Gly Cys Tyr |
| (SEQ ID NO: 5569) | Cys Glu Trp Cys Pro Asn Gly Ala Cys Thr Ala Cys Tyr |
| (SEQ ID NO: 5570) | Cys Glu Trp Cys Pro Asn Gly Ala Cys Val Gly Cys Tyr |
| (SEQ ID NO: 5571) | Cys Glu Trp Cys Pro Asn Gly Ala Cys Val Ala Cys Tyr |
| (SEQ ID NO: 5572) | Cys Glu Trp Cys Pro Asn Gly Ala Cys Gly Gly Cys Tyr |
| (SEQ ID NO: 5573) | Cys Glu Trp Cys Pro Asn Gly Ala Cys Gly Ala Cys Tyr |
| (SEQ ID NO: 5574) | Cys Glu Trp Cys Pro Asn Gly Thr Cys Thr Gly Cys Tyr |
| (SEQ ID NO: 5575) | Cys Glu Trp Cys Pro Asn Gly Thr Cys Thr Ala Cys Tyr |
| (SEQ ID NO: 5576) | Cys Glu Trp Cys Pro Asn Gly Thr Cys Val Gly Cys Tyr |
| (SEQ ID NO: 5577) | Cys Glu Trp Cys Pro Asn Gly Thr Cys Val Ala Cys Tyr |
| (SEQ ID NO: 5578) | Cys Glu Trp Cys Pro Asn Gly Thr Cys Gly Gly Cys Tyr |
| (SEQ ID NO: 5579) | Cys Glu Trp Cys Pro Asn Gly Thr Cys Gly Ala Cys Tyr |
| (SEQ ID NO: 5580) | Cys Glu Trp Cys Ser Asn Pro Ala Cys Thr Gly Cys Tyr |

FIG. 3

| | |
|---|---|
| (SEQ ID NO: 5581) | Cys Glu Trp Cys Ser Asn Pro Ala Cys Thr Ala Cys Tyr |
| (SEQ ID NO: 5582) | Cys Glu Trp Cys Ser Asn Pro Ala Cys Val Gly Cys Tyr |
| (SEQ ID NO: 5583) | Cys Glu Trp Cys Ser Asn Pro Ala Cys Val Ala Cys Tyr |
| (SEQ ID NO: 5584) | Cys Glu Trp Cys Ser Asn Pro Ala Cys Gly Gly Cys Tyr |
| (SEQ ID NO: 5585) | Cys Glu Trp Cys Ser Asn Pro Ala Cys Gly Ala Cys Tyr |
| (SEQ ID NO: 5586) | Cys Glu Trp Cys Ser Asn Pro Thr Cys Thr Gly Cys Tyr |
| (SEQ ID NO: 5587) | Cys Glu Trp Cys Ser Asn Pro Thr Cys Thr Ala Cys Tyr |
| (SEQ ID NO: 5588) | Cys Glu Trp Cys Ser Asn Pro Thr Cys Val Gly Cys Tyr |
| (SEQ ID NO: 5589) | Cys Glu Trp Cys Ser Asn Pro Thr Cys Val Ala Cys Tyr |
| (SEQ ID NO: 5590) | Cys Glu Trp Cys Ser Asn Pro Thr Cys Gly Gly Cys Tyr |
| (SEQ ID NO: 5591) | Cys Glu Trp Cys Ser Asn Pro Thr Cys Gly Ala Cys Tyr |
| (SEQ ID NO: 5592) | Cys Glu Trp Cys Ser Asn Gly Ala Cys Thr Gly Cys Tyr |
| (SEQ ID NO: 5593) | Cys Glu Trp Cys Ser Asn Gly Ala Cys Thr Ala Cys Tyr |
| (SEQ ID NO: 5594) | Cys Glu Trp Cys Ser Asn Gly Ala Cys Val Gly Cys Tyr |
| (SEQ ID NO: 5595) | Cys Glu Trp Cys Ser Asn Gly Ala Cys Val Ala Cys Tyr |
| (SEQ ID NO: 5596) | Cys Glu Trp Cys Ser Asn Gly Ala Cys Gly Gly Cys Tyr |
| (SEQ ID NO: 5597) | Cys Glu Trp Cys Ser Asn Gly Ala Cys Gly Ala Cys Tyr |
| (SEQ ID NO: 5598) | Cys Glu Trp Cys Ser Asn Gly Thr Cys Thr Gly Cys Tyr |
| (SEQ ID NO: 5599) | Cys Glu Trp Cys Ser Asn Gly Thr Cys Thr Ala Cys Tyr |
| (SEQ ID NO: 5600) | Cys Glu Trp Cys Ser Asn Gly Thr Cys Val Gly Cys Tyr |
| (SEQ ID NO: 5601) | Cys Glu Trp Cys Ser Asn Gly Thr Cys Val Ala Cys Tyr |
| (SEQ ID NO: 5602) | Cys Glu Trp Cys Ser Asn Gly Thr Cys Gly Gly Cys Tyr |
| (SEQ ID NO: 5603) | Cys Glu Trp Cys Ser Asn Gly Thr Cys Gly Ala Cys Tyr |
| (SEQ ID NO: 5604) | Cys Glu Trp Cys Thr Asn Pro Ala Cys Thr Gly Cys Tyr |
| (SEQ ID NO: 5605) | Cys Glu Trp Cys Thr Asn Pro Ala Cys Thr Ala Cys Tyr |
| (SEQ ID NO: 5606) | Cys Glu Trp Cys Thr Asn Pro Ala Cys Val Gly Cys Tyr |
| (SEQ ID NO: 5607) | Cys Glu Trp Cys Thr Asn Pro Ala Cys Val Ala Cys Tyr |
| (SEQ ID NO: 5608) | Cys Glu Trp Cys Thr Asn Pro Ala Cys Gly Gly Cys Tyr |
| (SEQ ID NO: 5609) | Cys Glu Trp Cys Thr Asn Pro Ala Cys Gly Ala Cys Tyr |
| (SEQ ID NO: 5610) | Cys Glu Trp Cys Thr Asn Pro Thr Cys Thr Gly Cys Tyr |
| (SEQ ID NO: 5611) | Cys Glu Trp Cys Thr Asn Pro Thr Cys Thr Ala Cys Tyr |
| (SEQ ID NO: 5612) | Cys Glu Trp Cys Thr Asn Pro Thr Cys Val Gly Cys Tyr |
| (SEQ ID NO: 5613) | Cys Glu Trp Cys Thr Asn Pro Thr Cys Val Ala Cys Tyr |
| (SEQ ID NO: 5614) | Cys Glu Trp Cys Thr Asn Pro Thr Cys Gly Gly Cys Tyr |
| (SEQ ID NO: 5615) | Cys Glu Trp Cys Thr Asn Pro Thr Cys Gly Ala Cys Tyr |
| (SEQ ID NO: 5616) | Cys Glu Trp Cys Thr Asn Gly Ala Cys Thr Gly Cys Tyr |
| (SEQ ID NO: 5617) | Cys Glu Trp Cys Thr Asn Gly Ala Cys Thr Ala Cys Tyr |
| (SEQ ID NO: 5618) | Cys Glu Trp Cys Thr Asn Gly Ala Cys Val Gly Cys Tyr |
| (SEQ ID NO: 5619) | Cys Glu Trp Cys Thr Asn Gly Ala Cys Val Ala Cys Tyr |
| (SEQ ID NO: 5620) | Cys Glu Trp Cys Thr Asn Gly Ala Cys Gly Gly Cys Tyr |
| (SEQ ID NO: 5621) | Cys Glu Trp Cys Thr Asn Gly Ala Cys Gly Ala Cys Tyr |
| (SEQ ID NO: 5622) | Cys Glu Trp Cys Thr Asn Gly Thr Cys Thr Gly Cys Tyr |
| (SEQ ID NO: 5623) | Cys Glu Trp Cys Thr Asn Gly Thr Cys Thr Ala Cys Tyr |

FIG. 3

(SEQ ID NO: 5624) Cys Glu Trp Cys Thr Asn Gly Thr Cys Val Gly Cys Tyr
(SEQ ID NO: 5625) Cys Glu Trp Cys Thr Asn Gly Thr Cys Val Ala Cys Tyr
(SEQ ID NO: 5626) Cys Glu Trp Cys Thr Asn Gly Thr Cys Gly Gly Cys Tyr
(SEQ ID NO: 5627) Cys Glu Trp Cys Thr Asn Gly Thr Cys Gly Ala Cys Tyr
(SEQ ID NO: 5628) Cys Glu Trp Cys Trp Asn Pro Ala Cys Thr Gly Cys Tyr
(SEQ ID NO: 5629) Cys Glu Trp Cys Trp Asn Pro Ala Cys Thr Ala Cys Tyr
(SEQ ID NO: 5630) Cys Glu Trp Cys Trp Asn Pro Ala Cys Val Gly Cys Tyr
(SEQ ID NO: 5631) Cys Glu Trp Cys Trp Asn Pro Ala Cys Val Ala Cys Tyr
(SEQ ID NO: 5632) Cys Glu Trp Cys Trp Asn Pro Ala Cys Gly Gly Cys Tyr
(SEQ ID NO: 5633) Cys Glu Trp Cys Trp Asn Pro Ala Cys Gly Ala Cys Tyr
(SEQ ID NO: 5634) Cys Glu Trp Cys Trp Asn Pro Thr Cys Thr Gly Cys Tyr
(SEQ ID NO: 5635) Cys Glu Trp Cys Trp Asn Pro Thr Cys Thr Ala Cys Tyr
(SEQ ID NO: 5636) Cys Glu Trp Cys Trp Asn Pro Thr Cys Val Gly Cys Tyr
(SEQ ID NO: 5637) Cys Glu Trp Cys Trp Asn Pro Thr Cys Val Ala Cys Tyr
(SEQ ID NO: 5638) Cys Glu Trp Cys Trp Asn Pro Thr Cys Gly Gly Cys Tyr
(SEQ ID NO: 5639) Cys Glu Trp Cys Trp Asn Pro Thr Cys Gly Ala Cys Tyr
(SEQ ID NO: 5640) Cys Glu Trp Cys Trp Asn Gly Ala Cys Thr Gly Cys Tyr
(SEQ ID NO: 5641) Cys Glu Trp Cys Trp Asn Gly Ala Cys Thr Ala Cys Tyr
(SEQ ID NO: 5642) Cys Glu Trp Cys Trp Asn Gly Ala Cys Val Gly Cys Tyr
(SEQ ID NO: 5643) Cys Glu Trp Cys Trp Asn Gly Ala Cys Val Ala Cys Tyr
(SEQ ID NO: 5644) Cys Glu Trp Cys Trp Asn Gly Ala Cys Gly Gly Cys Tyr
(SEQ ID NO: 5645) Cys Glu Trp Cys Trp Asn Gly Ala Cys Gly Ala Cys Tyr
(SEQ ID NO: 5646) Cys Glu Trp Cys Trp Asn Gly Thr Cys Thr Gly Cys Tyr
(SEQ ID NO: 5647) Cys Glu Trp Cys Trp Asn Gly Thr Cys Thr Ala Cys Tyr
(SEQ ID NO: 5648) Cys Glu Trp Cys Trp Asn Gly Thr Cys Val Gly Cys Tyr
(SEQ ID NO: 5649) Cys Glu Trp Cys Trp Asn Gly Thr Cys Val Ala Cys Tyr
(SEQ ID NO: 5650) Cys Glu Trp Cys Trp Asn Gly Thr Cys Gly Gly Cys Tyr
(SEQ ID NO: 5651) Cys Glu Trp Cys Trp Asn Gly Thr Cys Gly Ala Cys Tyr
(SEQ ID NO: 5652) Cys Glu Trp Cys Tyr Asn Pro Ala Cys Thr Gly Cys Tyr
(SEQ ID NO: 5653) Cys Glu Trp Cys Tyr Asn Pro Ala Cys Thr Ala Cys Tyr
(SEQ ID NO: 5654) Cys Glu Trp Cys Tyr Asn Pro Ala Cys Val Gly Cys Tyr
(SEQ ID NO: 5655) Cys Glu Trp Cys Tyr Asn Pro Ala Cys Val Ala Cys Tyr
(SEQ ID NO: 5656) Cys Glu Trp Cys Tyr Asn Pro Ala Cys Gly Gly Cys Tyr
(SEQ ID NO: 5657) Cys Glu Trp Cys Tyr Asn Pro Ala Cys Gly Ala Cys Tyr
(SEQ ID NO: 5658) Cys Glu Trp Cys Tyr Asn Pro Thr Cys Thr Gly Cys Tyr
(SEQ ID NO: 5659) Cys Glu Trp Cys Tyr Asn Pro Thr Cys Thr Ala Cys Tyr
(SEQ ID NO: 5660) Cys Glu Trp Cys Tyr Asn Pro Thr Cys Val Gly Cys Tyr
(SEQ ID NO: 5661) Cys Glu Trp Cys Tyr Asn Pro Thr Cys Val Ala Cys Tyr
(SEQ ID NO: 5662) Cys Glu Trp Cys Tyr Asn Pro Thr Cys Gly Gly Cys Tyr
(SEQ ID NO: 5663) Cys Glu Trp Cys Tyr Asn Pro Thr Cys Gly Ala Cys Tyr
(SEQ ID NO: 5664) Cys Glu Trp Cys Tyr Asn Gly Ala Cys Thr Gly Cys Tyr
(SEQ ID NO: 5665) Cys Glu Trp Cys Tyr Asn Gly Ala Cys Thr Ala Cys Tyr
(SEQ ID NO: 5666) Cys Glu Trp Cys Tyr Asn Gly Ala Cys Val Gly Cys Tyr

FIG. 3

| | |
|---|---|
| (SEQ ID NO: 5667) | Cys Glu Trp Cys Tyr Asn Gly Ala Cys Val Ala Cys Tyr |
| (SEQ ID NO: 5668) | Cys Glu Trp Cys Tyr Asn Gly Ala Cys Gly Gly Cys Tyr |
| (SEQ ID NO: 5669) | Cys Glu Trp Cys Tyr Asn Gly Ala Cys Gly Ala Cys Tyr |
| (SEQ ID NO: 5670) | Cys Glu Trp Cys Tyr Asn Gly Thr Cys Thr Gly Cys Tyr |
| (SEQ ID NO: 5671) | Cys Glu Trp Cys Tyr Asn Gly Thr Cys Thr Ala Cys Tyr |
| (SEQ ID NO: 5672) | Cys Glu Trp Cys Tyr Asn Gly Thr Cys Val Gly Cys Tyr |
| (SEQ ID NO: 5673) | Cys Glu Trp Cys Tyr Asn Gly Thr Cys Val Ala Cys Tyr |
| (SEQ ID NO: 5674) | Cys Glu Trp Cys Tyr Asn Gly Thr Cys Gly Gly Cys Tyr |
| (SEQ ID NO: 5675) | Cys Glu Trp Cys Tyr Asn Gly Thr Cys Gly Ala Cys Tyr |
| (SEQ ID NO: 5676) | Cys Glu Trp Cys Val Asn Pro Ala Cys Thr Gly Cys Tyr |
| (SEQ ID NO: 5677) | Cys Glu Trp Cys Val Asn Pro Ala Cys Thr Ala Cys Tyr |
| (SEQ ID NO: 5678) | Cys Glu Trp Cys Val Asn Pro Ala Cys Val Gly Cys Tyr |
| (SEQ ID NO: 5679) | Cys Glu Trp Cys Val Asn Pro Ala Cys Val Ala Cys Tyr |
| (SEQ ID NO: 5680) | Cys Glu Trp Cys Val Asn Pro Ala Cys Gly Gly Cys Tyr |
| (SEQ ID NO: 5681) | Cys Glu Trp Cys Val Asn Pro Ala Cys Gly Ala Cys Tyr |
| (SEQ ID NO: 5682) | Cys Glu Trp Cys Val Asn Pro Thr Cys Thr Gly Cys Tyr |
| (SEQ ID NO: 5683) | Cys Glu Trp Cys Val Asn Pro Thr Cys Thr Ala Cys Tyr |
| (SEQ ID NO: 5684) | Cys Glu Trp Cys Val Asn Pro Thr Cys Val Gly Cys Tyr |
| (SEQ ID NO: 5685) | Cys Glu Trp Cys Val Asn Pro Thr Cys Val Ala Cys Tyr |
| (SEQ ID NO: 5686) | Cys Glu Trp Cys Val Asn Pro Thr Cys Gly Gly Cys Tyr |
| (SEQ ID NO: 5687) | Cys Glu Trp Cys Val Asn Pro Thr Cys Gly Ala Cys Tyr |
| (SEQ ID NO: 5688) | Cys Glu Trp Cys Val Asn Gly Ala Cys Thr Gly Cys Tyr |
| (SEQ ID NO: 5689) | Cys Glu Trp Cys Val Asn Gly Ala Cys Thr Ala Cys Tyr |
| (SEQ ID NO: 5690) | Cys Glu Trp Cys Val Asn Gly Ala Cys Val Gly Cys Tyr |
| (SEQ ID NO: 5691) | Cys Glu Trp Cys Val Asn Gly Ala Cys Val Ala Cys Tyr |
| (SEQ ID NO: 5692) | Cys Glu Trp Cys Val Asn Gly Ala Cys Gly Gly Cys Tyr |
| (SEQ ID NO: 5693) | Cys Glu Trp Cys Val Asn Gly Ala Cys Gly Ala Cys Tyr |
| (SEQ ID NO: 5694) | Cys Glu Trp Cys Val Asn Gly Thr Cys Thr Gly Cys Tyr |
| (SEQ ID NO: 5695) | Cys Glu Trp Cys Val Asn Gly Thr Cys Thr Ala Cys Tyr |
| (SEQ ID NO: 5696) | Cys Glu Trp Cys Val Asn Gly Thr Cys Val Gly Cys Tyr |
| (SEQ ID NO: 5697) | Cys Glu Trp Cys Val Asn Gly Thr Cys Val Ala Cys Tyr |
| (SEQ ID NO: 5698) | Cys Glu Trp Cys Val Asn Gly Thr Cys Gly Gly Cys Tyr |
| (SEQ ID NO: 5699) | Cys Glu Trp Cys Val Asn Gly Thr Cys Gly Ala Cys Tyr |
| (SEQ ID NO: 5700) | Cys Glu Trp Cys --- Asn Pro Ala Cys Thr Gly Cys Tyr |
| (SEQ ID NO: 5701) | Cys Glu Trp Cys --- Asn Pro Ala Cys Thr Ala Cys Tyr |
| (SEQ ID NO: 5702) | Cys Glu Trp Cys --- Asn Pro Ala Cys Val Gly Cys Tyr |
| (SEQ ID NO: 5703) | Cys Glu Trp Cys --- Asn Pro Ala Cys Val Ala Cys Tyr |
| (SEQ ID NO: 5704) | Cys Glu Trp Cys --- Asn Pro Ala Cys Gly Gly Cys Tyr |
| (SEQ ID NO: 5705) | Cys Glu Trp Cys --- Asn Pro Ala Cys Gly Ala Cys Tyr |
| (SEQ ID NO: 5706) | Cys Glu Trp Cys --- Asn Pro Thr Cys Thr Gly Cys Tyr |
| (SEQ ID NO: 5707) | Cys Glu Trp Cys --- Asn Pro Thr Cys Thr Ala Cys Tyr |
| (SEQ ID NO: 5708) | Cys Glu Trp Cys --- Asn Pro Thr Cys Val Gly Cys Tyr |
| (SEQ ID NO: 5709) | Cys Glu Trp Cys --- Asn Pro Thr Cys Val Ala Cys Tyr |

FIG. 3

(SEQ ID NO: 5710 )   Cys Glu Trp Cys --- Asn Pro Thr Cys Gly Gly Cys Tyr
(SEQ ID NO: 5711 )   Cys Glu Trp Cys --- Asn Pro Thr Cys Gly Ala Cys Tyr
(SEQ ID NO: 5712 )   Cys Glu Trp Cys --- Asn Gly Ala Cys Thr Gly Cys Tyr
(SEQ ID NO: 5713 )   Cys Glu Trp Cys --- Asn Gly Ala Cys Thr Ala Cys Tyr
(SEQ ID NO: 5714 )   Cys Glu Trp Cys --- Asn Gly Ala Cys Val Gly Cys Tyr
(SEQ ID NO: 5715 )   Cys Glu Trp Cys --- Asn Gly Ala Cys Val Ala Cys Tyr
(SEQ ID NO: 5716 )   Cys Glu Trp Cys --- Asn Gly Ala Cys Gly Gly Cys Tyr
(SEQ ID NO: 5717 )   Cys Glu Trp Cys --- Asn Gly Ala Cys Gly Ala Cys Tyr
(SEQ ID NO: 5718 )   Cys Glu Trp Cys --- Asn Gly Thr Cys Thr Gly Cys Tyr
(SEQ ID NO: 5719 )   Cys Glu Trp Cys --- Asn Gly Thr Cys Thr Ala Cys Tyr
(SEQ ID NO: 5720 )   Cys Glu Trp Cys --- Asn Gly Thr Cys Val Gly Cys Tyr
(SEQ ID NO: 5721 )   Cys Glu Trp Cys --- Asn Gly Thr Cys Val Ala Cys Tyr
(SEQ ID NO: 5722 )   Cys Glu Trp Cys --- Asn Gly Thr Cys Gly Gly Cys Tyr
(SEQ ID NO: 5723 )   Cys Glu Trp Cys --- Asn Gly Thr Cys Gly Ala Cys Tyr
(SEQ ID NO: 5724 )   Cys Glu Phe Cys Ala Asn Pro Ala Cys Thr Gly Cys Tyr
(SEQ ID NO: 5725 )   Cys Glu Phe Cys Ala Asn Pro Ala Cys Thr Ala Cys Tyr
(SEQ ID NO: 5726 )   Cys Glu Phe Cys Ala Asn Pro Ala Cys Val Gly Cys Tyr
(SEQ ID NO: 5727 )   Cys Glu Phe Cys Ala Asn Pro Ala Cys Val Ala Cys Tyr
(SEQ ID NO: 5728 )   Cys Glu Phe Cys Ala Asn Pro Ala Cys Gly Gly Cys Tyr
(SEQ ID NO: 5729 )   Cys Glu Phe Cys Ala Asn Pro Ala Cys Gly Ala Cys Tyr
(SEQ ID NO: 5730 )   Cys Glu Phe Cys Ala Asn Pro Thr Cys Thr Gly Cys Tyr
(SEQ ID NO: 5731 )   Cys Glu Phe Cys Ala Asn Pro Thr Cys Thr Ala Cys Tyr
(SEQ ID NO: 5732 )   Cys Glu Phe Cys Ala Asn Pro Thr Cys Val Gly Cys Tyr
(SEQ ID NO: 5733 )   Cys Glu Phe Cys Ala Asn Pro Thr Cys Val Ala Cys Tyr
(SEQ ID NO: 5734 )   Cys Glu Phe Cys Ala Asn Pro Thr Cys Gly Gly Cys Tyr
(SEQ ID NO: 5735 )   Cys Glu Phe Cys Ala Asn Pro Thr Cys Gly Ala Cys Tyr
(SEQ ID NO: 5736 )   Cys Glu Phe Cys Ala Asn Gly Ala Cys Thr Gly Cys Tyr
(SEQ ID NO: 5737 )   Cys Glu Phe Cys Ala Asn Gly Ala Cys Thr Ala Cys Tyr
(SEQ ID NO: 5738 )   Cys Glu Phe Cys Ala Asn Gly Ala Cys Val Gly Cys Tyr
(SEQ ID NO: 5739 )   Cys Glu Phe Cys Ala Asn Gly Ala Cys Val Ala Cys Tyr
(SEQ ID NO: 5740 )   Cys Glu Phe Cys Ala Asn Gly Ala Cys Gly Gly Cys Tyr
(SEQ ID NO: 5741 )   Cys Glu Phe Cys Ala Asn Gly Ala Cys Gly Ala Cys Tyr
(SEQ ID NO: 5742 )   Cys Glu Phe Cys Ala Asn Gly Thr Cys Thr Gly Cys Tyr
(SEQ ID NO: 5743 )   Cys Glu Phe Cys Ala Asn Gly Thr Cys Thr Ala Cys Tyr
(SEQ ID NO: 5744 )   Cys Glu Phe Cys Ala Asn Gly Thr Cys Val Gly Cys Tyr
(SEQ ID NO: 5745 )   Cys Glu Phe Cys Ala Asn Gly Thr Cys Val Ala Cys Tyr
(SEQ ID NO: 5746 )   Cys Glu Phe Cys Ala Asn Gly Thr Cys Gly Gly Cys Tyr
(SEQ ID NO: 5747 )   Cys Glu Phe Cys Ala Asn Gly Thr Cys Gly Ala Cys Tyr
(SEQ ID NO: 5748 )   Cys Glu Phe Cys Arg Asn Pro Ala Cys Thr Gly Cys Tyr
(SEQ ID NO: 5749 )   Cys Glu Phe Cys Arg Asn Pro Ala Cys Thr Ala Cys Tyr
(SEQ ID NO: 5750 )   Cys Glu Phe Cys Arg Asn Pro Ala Cys Val Gly Cys Tyr
(SEQ ID NO: 5751 )   Cys Glu Phe Cys Arg Asn Pro Ala Cys Val Ala Cys Tyr
(SEQ ID NO: 5752 )   Cys Glu Phe Cys Arg Asn Pro Ala Cys Gly Gly Cys Tyr

FIG. 3

| | |
|---|---|
| (SEQ ID NO: 5753) | Cys Glu Phe Cys Arg Asn Pro Ala Cys Gly Ala Cys Tyr |
| (SEQ ID NO: 5754) | Cys Glu Phe Cys Arg Asn Pro Thr Cys Thr Gly Cys Tyr |
| (SEQ ID NO: 5755) | Cys Glu Phe Cys Arg Asn Pro Thr Cys Thr Ala Cys Tyr |
| (SEQ ID NO: 5756) | Cys Glu Phe Cys Arg Asn Pro Thr Cys Val Gly Cys Tyr |
| (SEQ ID NO: 5757) | Cys Glu Phe Cys Arg Asn Pro Thr Cys Val Ala Cys Tyr |
| (SEQ ID NO: 5758) | Cys Glu Phe Cys Arg Asn Pro Thr Cys Gly Gly Cys Tyr |
| (SEQ ID NO: 5759) | Cys Glu Phe Cys Arg Asn Pro Thr Cys Gly Ala Cys Tyr |
| (SEQ ID NO: 5760) | Cys Glu Phe Cys Arg Asn Gly Ala Cys Thr Gly Cys Tyr |
| (SEQ ID NO: 5761) | Cys Glu Phe Cys Arg Asn Gly Ala Cys Thr Ala Cys Tyr |
| (SEQ ID NO: 5762) | Cys Glu Phe Cys Arg Asn Gly Ala Cys Val Gly Cys Tyr |
| (SEQ ID NO: 5763) | Cys Glu Phe Cys Arg Asn Gly Ala Cys Val Ala Cys Tyr |
| (SEQ ID NO: 5764) | Cys Glu Phe Cys Arg Asn Gly Ala Cys Gly Gly Cys Tyr |
| (SEQ ID NO: 5765) | Cys Glu Phe Cys Arg Asn Gly Ala Cys Gly Ala Cys Tyr |
| (SEQ ID NO: 5766) | Cys Glu Phe Cys Arg Asn Gly Thr Cys Thr Gly Cys Tyr |
| (SEQ ID NO: 5767) | Cys Glu Phe Cys Arg Asn Gly Thr Cys Thr Ala Cys Tyr |
| (SEQ ID NO: 5768) | Cys Glu Phe Cys Arg Asn Gly Thr Cys Val Gly Cys Tyr |
| (SEQ ID NO: 5769) | Cys Glu Phe Cys Arg Asn Gly Thr Cys Val Ala Cys Tyr |
| (SEQ ID NO: 5770) | Cys Glu Phe Cys Arg Asn Gly Thr Cys Gly Gly Cys Tyr |
| (SEQ ID NO: 5771) | Cys Glu Phe Cys Arg Asn Gly Thr Cys Gly Ala Cys Tyr |
| (SEQ ID NO: 5772) | Cys Glu Phe Cys Asn Asn Pro Ala Cys Thr Gly Cys Tyr |
| (SEQ ID NO: 5773) | Cys Glu Phe Cys Asn Asn Pro Ala Cys Thr Ala Cys Tyr |
| (SEQ ID NO: 5774) | Cys Glu Phe Cys Asn Asn Pro Ala Cys Val Gly Cys Tyr |
| (SEQ ID NO: 5775) | Cys Glu Phe Cys Asn Asn Pro Ala Cys Val Ala Cys Tyr |
| (SEQ ID NO: 5776) | Cys Glu Phe Cys Asn Asn Pro Ala Cys Gly Gly Cys Tyr |
| (SEQ ID NO: 5777) | Cys Glu Phe Cys Asn Asn Pro Ala Cys Gly Ala Cys Tyr |
| (SEQ ID NO: 5778) | Cys Glu Phe Cys Asn Asn Pro Thr Cys Thr Gly Cys Tyr |
| (SEQ ID NO: 5779) | Cys Glu Phe Cys Asn Asn Pro Thr Cys Thr Ala Cys Tyr |
| (SEQ ID NO: 5780) | Cys Glu Phe Cys Asn Asn Pro Thr Cys Val Gly Cys Tyr |
| (SEQ ID NO: 5781) | Cys Glu Phe Cys Asn Asn Pro Thr Cys Val Ala Cys Tyr |
| (SEQ ID NO: 5782) | Cys Glu Phe Cys Asn Asn Pro Thr Cys Gly Gly Cys Tyr |
| (SEQ ID NO: 5783) | Cys Glu Phe Cys Asn Asn Pro Thr Cys Gly Ala Cys Tyr |
| (SEQ ID NO: 5784) | Cys Glu Phe Cys Asn Asn Gly Ala Cys Thr Gly Cys Tyr |
| (SEQ ID NO: 5785) | Cys Glu Phe Cys Asn Asn Gly Ala Cys Thr Ala Cys Tyr |
| (SEQ ID NO: 5786) | Cys Glu Phe Cys Asn Asn Gly Ala Cys Val Gly Cys Tyr |
| (SEQ ID NO: 5787) | Cys Glu Phe Cys Asn Asn Gly Ala Cys Val Ala Cys Tyr |
| (SEQ ID NO: 5788) | Cys Glu Phe Cys Asn Asn Gly Ala Cys Gly Gly Cys Tyr |
| (SEQ ID NO: 5789) | Cys Glu Phe Cys Asn Asn Gly Ala Cys Gly Ala Cys Tyr |
| (SEQ ID NO: 5790) | Cys Glu Phe Cys Asn Asn Gly Thr Cys Thr Gly Cys Tyr |
| (SEQ ID NO: 5791) | Cys Glu Phe Cys Asn Asn Gly Thr Cys Thr Ala Cys Tyr |
| (SEQ ID NO: 5792) | Cys Glu Phe Cys Asn Asn Gly Thr Cys Val Gly Cys Tyr |
| (SEQ ID NO: 5793) | Cys Glu Phe Cys Asn Asn Gly Thr Cys Val Ala Cys Tyr |
| (SEQ ID NO: 5794) | Cys Glu Phe Cys Asn Asn Gly Thr Cys Gly Gly Cys Tyr |
| (SEQ ID NO: 5795) | Cys Glu Phe Cys Asn Asn Gly Thr Cys Gly Ala Cys Tyr |

FIG. 3

(SEQ ID NO: 5796) Cys Glu Phe Cys Asp Asn Pro Ala Cys Thr Gly Cys Tyr
(SEQ ID NO: 5797) Cys Glu Phe Cys Asp Asn Pro Ala Cys Thr Ala Cys Tyr
(SEQ ID NO: 5798) Cys Glu Phe Cys Asp Asn Pro Ala Cys Val Gly Cys Tyr
(SEQ ID NO: 5799) Cys Glu Phe Cys Asp Asn Pro Ala Cys Val Ala Cys Tyr
(SEQ ID NO: 5800) Cys Glu Phe Cys Asp Asn Pro Ala Cys Gly Gly Cys Tyr
(SEQ ID NO: 5801) Cys Glu Phe Cys Asp Asn Pro Ala Cys Gly Ala Cys Tyr
(SEQ ID NO: 5802) Cys Glu Phe Cys Asp Asn Pro Thr Cys Thr Gly Cys Tyr
(SEQ ID NO: 5803) Cys Glu Phe Cys Asp Asn Pro Thr Cys Thr Ala Cys Tyr
(SEQ ID NO: 5804) Cys Glu Phe Cys Asp Asn Pro Thr Cys Val Gly Cys Tyr
(SEQ ID NO: 5805) Cys Glu Phe Cys Asp Asn Pro Thr Cys Val Ala Cys Tyr
(SEQ ID NO: 5806) Cys Glu Phe Cys Asp Asn Pro Thr Cys Gly Gly Cys Tyr
(SEQ ID NO: 5807) Cys Glu Phe Cys Asp Asn Pro Thr Cys Gly Ala Cys Tyr
(SEQ ID NO: 5808) Cys Glu Phe Cys Asp Asn Gly Ala Cys Thr Gly Cys Tyr
(SEQ ID NO: 5809) Cys Glu Phe Cys Asp Asn Gly Ala Cys Thr Ala Cys Tyr
(SEQ ID NO: 5810) Cys Glu Phe Cys Asp Asn Gly Ala Cys Val Gly Cys Tyr
(SEQ ID NO: 5811) Cys Glu Phe Cys Asp Asn Gly Ala Cys Val Ala Cys Tyr
(SEQ ID NO: 5812) Cys Glu Phe Cys Asp Asn Gly Ala Cys Gly Gly Cys Tyr
(SEQ ID NO: 5813) Cys Glu Phe Cys Asp Asn Gly Ala Cys Gly Ala Cys Tyr
(SEQ ID NO: 5814) Cys Glu Phe Cys Asp Asn Gly Thr Cys Thr Gly Cys Tyr
(SEQ ID NO: 5815) Cys Glu Phe Cys Asp Asn Gly Thr Cys Thr Ala Cys Tyr
(SEQ ID NO: 5816) Cys Glu Phe Cys Asp Asn Gly Thr Cys Val Gly Cys Tyr
(SEQ ID NO: 5817) Cys Glu Phe Cys Asp Asn Gly Thr Cys Val Ala Cys Tyr
(SEQ ID NO: 5818) Cys Glu Phe Cys Asp Asn Gly Thr Cys Gly Gly Cys Tyr
(SEQ ID NO: 5819) Cys Glu Phe Cys Asp Asn Gly Thr Cys Gly Ala Cys Tyr
(SEQ ID NO: 5820) Cys Glu Phe Cys Gln Asn Pro Ala Cys Thr Gly Cys Tyr
(SEQ ID NO: 5821) Cys Glu Phe Cys Gln Asn Pro Ala Cys Thr Ala Cys Tyr
(SEQ ID NO: 5822) Cys Glu Phe Cys Gln Asn Pro Ala Cys Val Gly Cys Tyr
(SEQ ID NO: 5823) Cys Glu Phe Cys Gln Asn Pro Ala Cys Val Ala Cys Tyr
(SEQ ID NO: 5824) Cys Glu Phe Cys Gln Asn Pro Ala Cys Gly Gly Cys Tyr
(SEQ ID NO: 5825) Cys Glu Phe Cys Gln Asn Pro Ala Cys Gly Ala Cys Tyr
(SEQ ID NO: 5826) Cys Glu Phe Cys Gln Asn Pro Thr Cys Thr Gly Cys Tyr
(SEQ ID NO: 5827) Cys Glu Phe Cys Gln Asn Pro Thr Cys Thr Ala Cys Tyr
(SEQ ID NO: 5828) Cys Glu Phe Cys Gln Asn Pro Thr Cys Val Gly Cys Tyr
(SEQ ID NO: 5829) Cys Glu Phe Cys Gln Asn Pro Thr Cys Val Ala Cys Tyr
(SEQ ID NO: 5830) Cys Glu Phe Cys Gln Asn Pro Thr Cys Gly Gly Cys Tyr
(SEQ ID NO: 5831) Cys Glu Phe Cys Gln Asn Pro Thr Cys Gly Ala Cys Tyr
(SEQ ID NO: 5832) Cys Glu Phe Cys Gln Asn Gly Ala Cys Thr Gly Cys Tyr
(SEQ ID NO: 5833) Cys Glu Phe Cys Gln Asn Gly Ala Cys Thr Ala Cys Tyr
(SEQ ID NO: 5834) Cys Glu Phe Cys Gln Asn Gly Ala Cys Val Gly Cys Tyr
(SEQ ID NO: 5835) Cys Glu Phe Cys Gln Asn Gly Ala Cys Val Ala Cys Tyr
(SEQ ID NO: 5836) Cys Glu Phe Cys Gln Asn Gly Ala Cys Gly Gly Cys Tyr
(SEQ ID NO: 5837) Cys Glu Phe Cys Gln Asn Gly Ala Cys Gly Ala Cys Tyr
(SEQ ID NO: 5838) Cys Glu Phe Cys Gln Asn Gly Thr Cys Thr Gly Cys Tyr

FIG. 3

(SEQ ID NO: 5839)  Cys Glu Phe Cys Gln Asn Gly Thr Cys Thr Ala Cys Tyr
(SEQ ID NO: 5840)  Cys Glu Phe Cys Gln Asn Gly Thr Cys Val Gly Cys Tyr
(SEQ ID NO: 5841)  Cys Glu Phe Cys Gln Asn Gly Thr Cys Val Ala Cys Tyr
(SEQ ID NO: 5842)  Cys Glu Phe Cys Gln Asn Gly Thr Cys Gly Gly Cys Tyr
(SEQ ID NO: 5843)  Cys Glu Phe Cys Gln Asn Gly Thr Cys Gly Ala Cys Tyr
(SEQ ID NO: 5844)  Cys Glu Phe Cys Glu Asn Pro Ala Cys Thr Gly Cys Tyr
(SEQ ID NO: 5845)  Cys Glu Phe Cys Glu Asn Pro Ala Cys Thr Ala Cys Tyr
(SEQ ID NO: 5846)  Cys Glu Phe Cys Glu Asn Pro Ala Cys Val Gly Cys Tyr
(SEQ ID NO: 5847)  Cys Glu Phe Cys Glu Asn Pro Ala Cys Val Ala Cys Tyr
(SEQ ID NO: 5848)  Cys Glu Phe Cys Glu Asn Pro Ala Cys Gly Gly Cys Tyr
(SEQ ID NO: 5849)  Cys Glu Phe Cys Glu Asn Pro Ala Cys Gly Ala Cys Tyr
(SEQ ID NO: 5850)  Cys Glu Phe Cys Glu Asn Pro Thr Cys Thr Gly Cys Tyr
(SEQ ID NO: 5851)  Cys Glu Phe Cys Glu Asn Pro Thr Cys Thr Ala Cys Tyr
(SEQ ID NO: 5852)  Cys Glu Phe Cys Glu Asn Pro Thr Cys Val Gly Cys Tyr
(SEQ ID NO: 5853)  Cys Glu Phe Cys Glu Asn Pro Thr Cys Val Ala Cys Tyr
(SEQ ID NO: 5854)  Cys Glu Phe Cys Glu Asn Pro Thr Cys Gly Gly Cys Tyr
(SEQ ID NO: 5855)  Cys Glu Phe Cys Glu Asn Pro Thr Cys Gly Ala Cys Tyr
(SEQ ID NO: 5856)  Cys Glu Phe Cys Glu Asn Gly Ala Cys Thr Gly Cys Tyr
(SEQ ID NO: 5857)  Cys Glu Phe Cys Glu Asn Gly Ala Cys Thr Ala Cys Tyr
(SEQ ID NO: 5858)  Cys Glu Phe Cys Glu Asn Gly Ala Cys Val Gly Cys Tyr
(SEQ ID NO: 5859)  Cys Glu Phe Cys Glu Asn Gly Ala Cys Val Ala Cys Tyr
(SEQ ID NO: 5860)  Cys Glu Phe Cys Glu Asn Gly Ala Cys Gly Gly Cys Tyr
(SEQ ID NO: 5861)  Cys Glu Phe Cys Glu Asn Gly Ala Cys Gly Ala Cys Tyr
(SEQ ID NO: 5862)  Cys Glu Phe Cys Glu Asn Gly Thr Cys Thr Gly Cys Tyr
(SEQ ID NO: 5863)  Cys Glu Phe Cys Glu Asn Gly Thr Cys Thr Ala Cys Tyr
(SEQ ID NO: 5864)  Cys Glu Phe Cys Glu Asn Gly Thr Cys Val Gly Cys Tyr
(SEQ ID NO: 5865)  Cys Glu Phe Cys Glu Asn Gly Thr Cys Val Ala Cys Tyr
(SEQ ID NO: 5866)  Cys Glu Phe Cys Glu Asn Gly Thr Cys Gly Gly Cys Tyr
(SEQ ID NO: 5867)  Cys Glu Phe Cys Glu Asn Gly Thr Cys Gly Ala Cys Tyr
(SEQ ID NO: 5868)  Cys Glu Phe Cys Gly Asn Pro Ala Cys Thr Gly Cys Tyr
(SEQ ID NO: 5869)  Cys Glu Phe Cys Gly Asn Pro Ala Cys Thr Ala Cys Tyr
(SEQ ID NO: 5870)  Cys Glu Phe Cys Gly Asn Pro Ala Cys Val Gly Cys Tyr
(SEQ ID NO: 5871)  Cys Glu Phe Cys Gly Asn Pro Ala Cys Val Ala Cys Tyr
(SEQ ID NO: 5872)  Cys Glu Phe Cys Gly Asn Pro Ala Cys Gly Gly Cys Tyr
(SEQ ID NO: 5873)  Cys Glu Phe Cys Gly Asn Pro Ala Cys Gly Ala Cys Tyr
(SEQ ID NO: 5874)  Cys Glu Phe Cys Gly Asn Pro Thr Cys Thr Gly Cys Tyr
(SEQ ID NO: 5875)  Cys Glu Phe Cys Gly Asn Pro Thr Cys Thr Ala Cys Tyr
(SEQ ID NO: 5876)  Cys Glu Phe Cys Gly Asn Pro Thr Cys Val Gly Cys Tyr
(SEQ ID NO: 5877)  Cys Glu Phe Cys Gly Asn Pro Thr Cys Val Ala Cys Tyr
(SEQ ID NO: 5878)  Cys Glu Phe Cys Gly Asn Pro Thr Cys Gly Gly Cys Tyr
(SEQ ID NO: 5879)  Cys Glu Phe Cys Gly Asn Pro Thr Cys Gly Ala Cys Tyr
(SEQ ID NO: 5880)  Cys Glu Phe Cys Gly Asn Gly Ala Cys Thr Gly Cys Tyr
(SEQ ID NO: 5881)  Cys Glu Phe Cys Gly Asn Gly Ala Cys Thr Ala Cys Tyr

FIG. 3

(SEQ ID NO: 5882) Cys Glu Phe Cys Gly Asn Gly Ala Cys Val Gly Cys Tyr
(SEQ ID NO: 5883) Cys Glu Phe Cys Gly Asn Gly Ala Cys Val Ala Cys Tyr
(SEQ ID NO: 5884) Cys Glu Phe Cys Gly Asn Gly Ala Cys Gly Gly Cys Tyr
(SEQ ID NO: 5885) Cys Glu Phe Cys Gly Asn Gly Ala Cys Gly Ala Cys Tyr
(SEQ ID NO: 5886) Cys Glu Phe Cys Gly Asn Gly Thr Cys Thr Gly Cys Tyr
(SEQ ID NO: 5887) Cys Glu Phe Cys Gly Asn Gly Thr Cys Thr Ala Cys Tyr
(SEQ ID NO: 5888) Cys Glu Phe Cys Gly Asn Gly Thr Cys Val Gly Cys Tyr
(SEQ ID NO: 5889) Cys Glu Phe Cys Gly Asn Gly Thr Cys Val Ala Cys Tyr
(SEQ ID NO: 5890) Cys Glu Phe Cys Gly Asn Gly Thr Cys Gly Gly Cys Tyr
(SEQ ID NO: 5891) Cys Glu Phe Cys Gly Asn Gly Thr Cys Gly Ala Cys Tyr
(SEQ ID NO: 5892) Cys Glu Phe Cys His Asn Pro Ala Cys Thr Gly Cys Tyr
(SEQ ID NO: 5893) Cys Glu Phe Cys His Asn Pro Ala Cys Thr Ala Cys Tyr
(SEQ ID NO: 5894) Cys Glu Phe Cys His Asn Pro Ala Cys Val Gly Cys Tyr
(SEQ ID NO: 5895) Cys Glu Phe Cys His Asn Pro Ala Cys Val Ala Cys Tyr
(SEQ ID NO: 5896) Cys Glu Phe Cys His Asn Pro Ala Cys Gly Gly Cys Tyr
(SEQ ID NO: 5897) Cys Glu Phe Cys His Asn Pro Ala Cys Gly Ala Cys Tyr
(SEQ ID NO: 5898) Cys Glu Phe Cys His Asn Pro Thr Cys Thr Gly Cys Tyr
(SEQ ID NO: 5899) Cys Glu Phe Cys His Asn Pro Thr Cys Thr Ala Cys Tyr
(SEQ ID NO: 5900) Cys Glu Phe Cys His Asn Pro Thr Cys Val Gly Cys Tyr
(SEQ ID NO: 5901) Cys Glu Phe Cys His Asn Pro Thr Cys Val Ala Cys Tyr
(SEQ ID NO: 5902) Cys Glu Phe Cys His Asn Pro Thr Cys Gly Gly Cys Tyr
(SEQ ID NO: 5903) Cys Glu Phe Cys His Asn Pro Thr Cys Gly Ala Cys Tyr
(SEQ ID NO: 5904) Cys Glu Phe Cys His Asn Gly Ala Cys Thr Gly Cys Tyr
(SEQ ID NO: 5905) Cys Glu Phe Cys His Asn Gly Ala Cys Thr Ala Cys Tyr
(SEQ ID NO: 5906) Cys Glu Phe Cys His Asn Gly Ala Cys Val Gly Cys Tyr
(SEQ ID NO: 5907) Cys Glu Phe Cys His Asn Gly Ala Cys Val Ala Cys Tyr
(SEQ ID NO: 5908) Cys Glu Phe Cys His Asn Gly Ala Cys Gly Gly Cys Tyr
(SEQ ID NO: 5909) Cys Glu Phe Cys His Asn Gly Ala Cys Gly Ala Cys Tyr
(SEQ ID NO: 5910) Cys Glu Phe Cys His Asn Gly Thr Cys Thr Gly Cys Tyr
(SEQ ID NO: 5911) Cys Glu Phe Cys His Asn Gly Thr Cys Thr Ala Cys Tyr
(SEQ ID NO: 5912) Cys Glu Phe Cys His Asn Gly Thr Cys Val Gly Cys Tyr
(SEQ ID NO: 5913) Cys Glu Phe Cys His Asn Gly Thr Cys Val Ala Cys Tyr
(SEQ ID NO: 5914) Cys Glu Phe Cys His Asn Gly Thr Cys Gly Gly Cys Tyr
(SEQ ID NO: 5915) Cys Glu Phe Cys His Asn Gly Thr Cys Gly Ala Cys Tyr
(SEQ ID NO: 5916) Cys Glu Phe Cys Ile Asn Pro Ala Cys Thr Gly Cys Tyr
(SEQ ID NO: 5917) Cys Glu Phe Cys Ile Asn Pro Ala Cys Thr Ala Cys Tyr
(SEQ ID NO: 5918) Cys Glu Phe Cys Ile Asn Pro Ala Cys Val Gly Cys Tyr
(SEQ ID NO: 5919) Cys Glu Phe Cys Ile Asn Pro Ala Cys Val Ala Cys Tyr
(SEQ ID NO: 5920) Cys Glu Phe Cys Ile Asn Pro Ala Cys Gly Gly Cys Tyr
(SEQ ID NO: 5921) Cys Glu Phe Cys Ile Asn Pro Ala Cys Gly Ala Cys Tyr
(SEQ ID NO: 5922) Cys Glu Phe Cys Ile Asn Pro Thr Cys Thr Gly Cys Tyr
(SEQ ID NO: 5923) Cys Glu Phe Cys Ile Asn Pro Thr Cys Thr Ala Cys Tyr
(SEQ ID NO: 5924) Cys Glu Phe Cys Ile Asn Pro Thr Cys Val Gly Cys Tyr

FIG. 3

(SEQ ID NO: 5925)  Cys Glu Phe Cys Ile Asn Pro Thr Cys Val Ala Cys Tyr
(SEQ ID NO: 5926)  Cys Glu Phe Cys Ile Asn Pro Thr Cys Gly Gly Cys Tyr
(SEQ ID NO: 5927)  Cys Glu Phe Cys Ile Asn Pro Thr Cys Gly Ala Cys Tyr
(SEQ ID NO: 5928)  Cys Glu Phe Cys Ile Asn Gly Ala Cys Thr Gly Cys Tyr
(SEQ ID NO: 5929)  Cys Glu Phe Cys Ile Asn Gly Ala Cys Thr Ala Cys Tyr
(SEQ ID NO: 5930)  Cys Glu Phe Cys Ile Asn Gly Ala Cys Val Gly Cys Tyr
(SEQ ID NO: 5931)  Cys Glu Phe Cys Ile Asn Gly Ala Cys Val Ala Cys Tyr
(SEQ ID NO: 5932)  Cys Glu Phe Cys Ile Asn Gly Ala Cys Gly Gly Cys Tyr
(SEQ ID NO: 5933)  Cys Glu Phe Cys Ile Asn Gly Ala Cys Gly Ala Cys Tyr
(SEQ ID NO: 5934)  Cys Glu Phe Cys Ile Asn Gly Thr Cys Thr Gly Cys Tyr
(SEQ ID NO: 5935)  Cys Glu Phe Cys Ile Asn Gly Thr Cys Thr Ala Cys Tyr
(SEQ ID NO: 5936)  Cys Glu Phe Cys Ile Asn Gly Thr Cys Val Gly Cys Tyr
(SEQ ID NO: 5937)  Cys Glu Phe Cys Ile Asn Gly Thr Cys Val Ala Cys Tyr
(SEQ ID NO: 5938)  Cys Glu Phe Cys Ile Asn Gly Thr Cys Gly Gly Cys Tyr
(SEQ ID NO: 5939)  Cys Glu Phe Cys Ile Asn Gly Thr Cys Gly Ala Cys Tyr
(SEQ ID NO: 5940)  Cys Glu Phe Cys Leu Asn Pro Ala Cys Thr Gly Cys Tyr
(SEQ ID NO: 5941)  Cys Glu Phe Cys Leu Asn Pro Ala Cys Thr Ala Cys Tyr
(SEQ ID NO: 5942)  Cys Glu Phe Cys Leu Asn Pro Ala Cys Val Gly Cys Tyr
(SEQ ID NO: 5943)  Cys Glu Phe Cys Leu Asn Pro Ala Cys Val Ala Cys Tyr
(SEQ ID NO: 5944)  Cys Glu Phe Cys Leu Asn Pro Ala Cys Gly Gly Cys Tyr
(SEQ ID NO: 5945)  Cys Glu Phe Cys Leu Asn Pro Ala Cys Gly Ala Cys Tyr
(SEQ ID NO: 5946)  Cys Glu Phe Cys Leu Asn Pro Thr Cys Thr Gly Cys Tyr
(SEQ ID NO: 5947)  Cys Glu Phe Cys Leu Asn Pro Thr Cys Thr Ala Cys Tyr
(SEQ ID NO: 5948)  Cys Glu Phe Cys Leu Asn Pro Thr Cys Val Gly Cys Tyr
(SEQ ID NO: 5949)  Cys Glu Phe Cys Leu Asn Pro Thr Cys Val Ala Cys Tyr
(SEQ ID NO: 5950)  Cys Glu Phe Cys Leu Asn Pro Thr Cys Gly Gly Cys Tyr
(SEQ ID NO: 5951)  Cys Glu Phe Cys Leu Asn Pro Thr Cys Gly Ala Cys Tyr
(SEQ ID NO: 5952)  Cys Glu Phe Cys Leu Asn Gly Ala Cys Thr Gly Cys Tyr
(SEQ ID NO: 5953)  Cys Glu Phe Cys Leu Asn Gly Ala Cys Thr Ala Cys Tyr
(SEQ ID NO: 5954)  Cys Glu Phe Cys Leu Asn Gly Ala Cys Val Gly Cys Tyr
(SEQ ID NO: 5955)  Cys Glu Phe Cys Leu Asn Gly Ala Cys Val Ala Cys Tyr
(SEQ ID NO: 5956)  Cys Glu Phe Cys Leu Asn Gly Ala Cys Gly Gly Cys Tyr
(SEQ ID NO: 5957)  Cys Glu Phe Cys Leu Asn Gly Ala Cys Gly Ala Cys Tyr
(SEQ ID NO: 5958)  Cys Glu Phe Cys Leu Asn Gly Thr Cys Thr Gly Cys Tyr
(SEQ ID NO: 5959)  Cys Glu Phe Cys Leu Asn Gly Thr Cys Thr Ala Cys Tyr
(SEQ ID NO: 5960)  Cys Glu Phe Cys Leu Asn Gly Thr Cys Val Gly Cys Tyr
(SEQ ID NO: 5961)  Cys Glu Phe Cys Leu Asn Gly Thr Cys Val Ala Cys Tyr
(SEQ ID NO: 5962)  Cys Glu Phe Cys Leu Asn Gly Thr Cys Gly Gly Cys Tyr
(SEQ ID NO: 5963)  Cys Glu Phe Cys Leu Asn Gly Thr Cys Gly Ala Cys Tyr
(SEQ ID NO: 5964)  Cys Glu Phe Cys Lys Asn Pro Ala Cys Thr Gly Cys Tyr
(SEQ ID NO: 5965)  Cys Glu Phe Cys Lys Asn Pro Ala Cys Thr Ala Cys Tyr
(SEQ ID NO: 5966)  Cys Glu Phe Cys Lys Asn Pro Ala Cys Val Gly Cys Tyr
(SEQ ID NO: 5967)  Cys Glu Phe Cys Lys Asn Pro Ala Cys Val Ala Cys Tyr

FIG. 3

(SEQ ID NO: 5968)  Cys Glu Phe Cys Lys Asn Pro Ala Cys Gly Gly Cys Tyr
(SEQ ID NO: 5969)  Cys Glu Phe Cys Lys Asn Pro Ala Cys Gly Ala Cys Tyr
(SEQ ID NO: 5970)  Cys Glu Phe Cys Lys Asn Pro Thr Cys Thr Gly Cys Tyr
(SEQ ID NO: 5971)  Cys Glu Phe Cys Lys Asn Pro Thr Cys Thr Ala Cys Tyr
(SEQ ID NO: 5972)  Cys Glu Phe Cys Lys Asn Pro Thr Cys Val Gly Cys Tyr
(SEQ ID NO: 5973)  Cys Glu Phe Cys Lys Asn Pro Thr Cys Val Ala Cys Tyr
(SEQ ID NO: 5974)  Cys Glu Phe Cys Lys Asn Pro Thr Cys Gly Gly Cys Tyr
(SEQ ID NO: 5975)  Cys Glu Phe Cys Lys Asn Pro Thr Cys Gly Ala Cys Tyr
(SEQ ID NO: 5976)  Cys Glu Phe Cys Lys Asn Gly Ala Cys Thr Gly Cys Tyr
(SEQ ID NO: 5977)  Cys Glu Phe Cys Lys Asn Gly Ala Cys Thr Ala Cys Tyr
(SEQ ID NO: 5978)  Cys Glu Phe Cys Lys Asn Gly Ala Cys Val Gly Cys Tyr
(SEQ ID NO: 5979)  Cys Glu Phe Cys Lys Asn Gly Ala Cys Val Ala Cys Tyr
(SEQ ID NO: 5980)  Cys Glu Phe Cys Lys Asn Gly Ala Cys Gly Gly Cys Tyr
(SEQ ID NO: 5981)  Cys Glu Phe Cys Lys Asn Gly Ala Cys Gly Ala Cys Tyr
(SEQ ID NO: 5982)  Cys Glu Phe Cys Lys Asn Gly Thr Cys Thr Gly Cys Tyr
(SEQ ID NO: 5983)  Cys Glu Phe Cys Lys Asn Gly Thr Cys Thr Ala Cys Tyr
(SEQ ID NO: 5984)  Cys Glu Phe Cys Lys Asn Gly Thr Cys Val Gly Cys Tyr
(SEQ ID NO: 5985)  Cys Glu Phe Cys Lys Asn Gly Thr Cys Val Ala Cys Tyr
(SEQ ID NO: 5986)  Cys Glu Phe Cys Lys Asn Gly Thr Cys Gly Gly Cys Tyr
(SEQ ID NO: 5987)  Cys Glu Phe Cys Lys Asn Gly Thr Cys Gly Ala Cys Tyr
(SEQ ID NO: 5988)  Cys Glu Phe Cys Met Asn Pro Ala Cys Thr Gly Cys Tyr
(SEQ ID NO: 5989)  Cys Glu Phe Cys Met Asn Pro Ala Cys Thr Ala Cys Tyr
(SEQ ID NO: 5990)  Cys Glu Phe Cys Met Asn Pro Ala Cys Val Gly Cys Tyr
(SEQ ID NO: 5991)  Cys Glu Phe Cys Met Asn Pro Ala Cys Val Ala Cys Tyr
(SEQ ID NO: 5992)  Cys Glu Phe Cys Met Asn Pro Ala Cys Gly Gly Cys Tyr
(SEQ ID NO: 5993)  Cys Glu Phe Cys Met Asn Pro Ala Cys Gly Ala Cys Tyr
(SEQ ID NO: 5994)  Cys Glu Phe Cys Met Asn Pro Thr Cys Thr Gly Cys Tyr
(SEQ ID NO: 5995)  Cys Glu Phe Cys Met Asn Pro Thr Cys Thr Ala Cys Tyr
(SEQ ID NO: 5996)  Cys Glu Phe Cys Met Asn Pro Thr Cys Val Gly Cys Tyr
(SEQ ID NO: 5997)  Cys Glu Phe Cys Met Asn Pro Thr Cys Val Ala Cys Tyr
(SEQ ID NO: 5998)  Cys Glu Phe Cys Met Asn Pro Thr Cys Gly Gly Cys Tyr
(SEQ ID NO: 5999)  Cys Glu Phe Cys Met Asn Pro Thr Cys Gly Ala Cys Tyr
(SEQ ID NO: 6000)  Cys Glu Phe Cys Met Asn Gly Ala Cys Thr Gly Cys Tyr
(SEQ ID NO: 6001)  Cys Glu Phe Cys Met Asn Gly Ala Cys Thr Ala Cys Tyr
(SEQ ID NO: 6002)  Cys Glu Phe Cys Met Asn Gly Ala Cys Val Gly Cys Tyr
(SEQ ID NO: 6003)  Cys Glu Phe Cys Met Asn Gly Ala Cys Val Ala Cys Tyr
(SEQ ID NO: 6004)  Cys Glu Phe Cys Met Asn Gly Ala Cys Gly Gly Cys Tyr
(SEQ ID NO: 6005)  Cys Glu Phe Cys Met Asn Gly Ala Cys Gly Ala Cys Tyr
(SEQ ID NO: 6006)  Cys Glu Phe Cys Met Asn Gly Thr Cys Thr Gly Cys Tyr
(SEQ ID NO: 6007)  Cys Glu Phe Cys Met Asn Gly Thr Cys Thr Ala Cys Tyr
(SEQ ID NO: 6008)  Cys Glu Phe Cys Met Asn Gly Thr Cys Val Gly Cys Tyr
(SEQ ID NO: 6009)  Cys Glu Phe Cys Met Asn Gly Thr Cys Val Ala Cys Tyr
(SEQ ID NO: 6010)  Cys Glu Phe Cys Met Asn Gly Thr Cys Gly Gly Cys Tyr

FIG. 3

| | |
|---|---|
| (SEQ ID NO: 6011) | Cys Glu Phe Cys Met Asn Gly Thr Cys Gly Ala Cys Tyr |
| (SEQ ID NO: 6012) | Cys Glu Phe Cys Phe Asn Pro Ala Cys Thr Gly Cys Tyr |
| (SEQ ID NO: 6013) | Cys Glu Phe Cys Phe Asn Pro Ala Cys Thr Ala Cys Tyr |
| (SEQ ID NO: 6014) | Cys Glu Phe Cys Phe Asn Pro Ala Cys Val Gly Cys Tyr |
| (SEQ ID NO: 6015) | Cys Glu Phe Cys Phe Asn Pro Ala Cys Val Ala Cys Tyr |
| (SEQ ID NO: 6016) | Cys Glu Phe Cys Phe Asn Pro Ala Cys Gly Gly Cys Tyr |
| (SEQ ID NO: 6017) | Cys Glu Phe Cys Phe Asn Pro Ala Cys Gly Ala Cys Tyr |
| (SEQ ID NO: 6018) | Cys Glu Phe Cys Phe Asn Pro Thr Cys Thr Gly Cys Tyr |
| (SEQ ID NO: 6019) | Cys Glu Phe Cys Phe Asn Pro Thr Cys Thr Ala Cys Tyr |
| (SEQ ID NO: 6020) | Cys Glu Phe Cys Phe Asn Pro Thr Cys Val Gly Cys Tyr |
| (SEQ ID NO: 6021) | Cys Glu Phe Cys Phe Asn Pro Thr Cys Val Ala Cys Tyr |
| (SEQ ID NO: 6022) | Cys Glu Phe Cys Phe Asn Pro Thr Cys Gly Gly Cys Tyr |
| (SEQ ID NO: 6023) | Cys Glu Phe Cys Phe Asn Pro Thr Cys Gly Ala Cys Tyr |
| (SEQ ID NO: 6024) | Cys Glu Phe Cys Phe Asn Gly Ala Cys Thr Gly Cys Tyr |
| (SEQ ID NO: 6025) | Cys Glu Phe Cys Phe Asn Gly Ala Cys Thr Ala Cys Tyr |
| (SEQ ID NO: 6026) | Cys Glu Phe Cys Phe Asn Gly Ala Cys Val Gly Cys Tyr |
| (SEQ ID NO: 6027) | Cys Glu Phe Cys Phe Asn Gly Ala Cys Val Ala Cys Tyr |
| (SEQ ID NO: 6028) | Cys Glu Phe Cys Phe Asn Gly Ala Cys Gly Gly Cys Tyr |
| (SEQ ID NO: 6029) | Cys Glu Phe Cys Phe Asn Gly Ala Cys Gly Ala Cys Tyr |
| (SEQ ID NO: 6030) | Cys Glu Phe Cys Phe Asn Gly Thr Cys Thr Gly Cys Tyr |
| (SEQ ID NO: 6031) | Cys Glu Phe Cys Phe Asn Gly Thr Cys Thr Ala Cys Tyr |
| (SEQ ID NO: 6032) | Cys Glu Phe Cys Phe Asn Gly Thr Cys Val Gly Cys Tyr |
| (SEQ ID NO: 6033) | Cys Glu Phe Cys Phe Asn Gly Thr Cys Val Ala Cys Tyr |
| (SEQ ID NO: 6034) | Cys Glu Phe Cys Phe Asn Gly Thr Cys Gly Gly Cys Tyr |
| (SEQ ID NO: 6035) | Cys Glu Phe Cys Phe Asn Gly Thr Cys Gly Ala Cys Tyr |
| (SEQ ID NO: 6036) | Cys Glu Phe Cys Pro Asn Pro Ala Cys Thr Gly Cys Tyr |
| (SEQ ID NO: 6037) | Cys Glu Phe Cys Pro Asn Pro Ala Cys Thr Ala Cys Tyr |
| (SEQ ID NO: 6038) | Cys Glu Phe Cys Pro Asn Pro Ala Cys Val Gly Cys Tyr |
| (SEQ ID NO: 6039) | Cys Glu Phe Cys Pro Asn Pro Ala Cys Val Ala Cys Tyr |
| (SEQ ID NO: 6040) | Cys Glu Phe Cys Pro Asn Pro Ala Cys Gly Gly Cys Tyr |
| (SEQ ID NO: 6041) | Cys Glu Phe Cys Pro Asn Pro Ala Cys Gly Ala Cys Tyr |
| (SEQ ID NO: 6042) | Cys Glu Phe Cys Pro Asn Pro Thr Cys Thr Gly Cys Tyr |
| (SEQ ID NO: 6043) | Cys Glu Phe Cys Pro Asn Pro Thr Cys Thr Ala Cys Tyr |
| (SEQ ID NO: 6044) | Cys Glu Phe Cys Pro Asn Pro Thr Cys Val Gly Cys Tyr |
| (SEQ ID NO: 6045) | Cys Glu Phe Cys Pro Asn Pro Thr Cys Val Ala Cys Tyr |
| (SEQ ID NO: 6046) | Cys Glu Phe Cys Pro Asn Pro Thr Cys Gly Gly Cys Tyr |
| (SEQ ID NO: 6047) | Cys Glu Phe Cys Pro Asn Pro Thr Cys Gly Ala Cys Tyr |
| (SEQ ID NO: 6048) | Cys Glu Phe Cys Pro Asn Gly Ala Cys Thr Gly Cys Tyr |
| (SEQ ID NO: 6049) | Cys Glu Phe Cys Pro Asn Gly Ala Cys Thr Ala Cys Tyr |
| (SEQ ID NO: 6050) | Cys Glu Phe Cys Pro Asn Gly Ala Cys Val Gly Cys Tyr |
| (SEQ ID NO: 6051) | Cys Glu Phe Cys Pro Asn Gly Ala Cys Val Ala Cys Tyr |
| (SEQ ID NO: 6052) | Cys Glu Phe Cys Pro Asn Gly Ala Cys Gly Gly Cys Tyr |
| (SEQ ID NO: 6053) | Cys Glu Phe Cys Pro Asn Gly Ala Cys Gly Ala Cys Tyr |

FIG. 3

(SEQ ID NO: 6054) Cys Glu Phe Cys Pro Asn Gly Thr Cys Thr Gly Cys Tyr
(SEQ ID NO: 6055) Cys Glu Phe Cys Pro Asn Gly Thr Cys Thr Ala Cys Tyr
(SEQ ID NO: 6056) Cys Glu Phe Cys Pro Asn Gly Thr Cys Val Gly Cys Tyr
(SEQ ID NO: 6057) Cys Glu Phe Cys Pro Asn Gly Thr Cys Val Ala Cys Tyr
(SEQ ID NO: 6058) Cys Glu Phe Cys Pro Asn Gly Thr Cys Gly Gly Cys Tyr
(SEQ ID NO: 6059) Cys Glu Phe Cys Pro Asn Gly Thr Cys Gly Ala Cys Tyr
(SEQ ID NO: 6060) Cys Glu Phe Cys Ser Asn Pro Ala Cys Thr Gly Cys Tyr
(SEQ ID NO: 6061) Cys Glu Phe Cys Ser Asn Pro Ala Cys Thr Ala Cys Tyr
(SEQ ID NO: 6062) Cys Glu Phe Cys Ser Asn Pro Ala Cys Val Gly Cys Tyr
(SEQ ID NO: 6063) Cys Glu Phe Cys Ser Asn Pro Ala Cys Val Ala Cys Tyr
(SEQ ID NO: 6064) Cys Glu Phe Cys Ser Asn Pro Ala Cys Gly Gly Cys Tyr
(SEQ ID NO: 6065) Cys Glu Phe Cys Ser Asn Pro Ala Cys Gly Ala Cys Tyr
(SEQ ID NO: 6066) Cys Glu Phe Cys Ser Asn Pro Thr Cys Thr Gly Cys Tyr
(SEQ ID NO: 6067) Cys Glu Phe Cys Ser Asn Pro Thr Cys Thr Ala Cys Tyr
(SEQ ID NO: 6068) Cys Glu Phe Cys Ser Asn Pro Thr Cys Val Gly Cys Tyr
(SEQ ID NO: 6069) Cys Glu Phe Cys Ser Asn Pro Thr Cys Val Ala Cys Tyr
(SEQ ID NO: 6070) Cys Glu Phe Cys Ser Asn Pro Thr Cys Gly Gly Cys Tyr
(SEQ ID NO: 6071) Cys Glu Phe Cys Ser Asn Pro Thr Cys Gly Ala Cys Tyr
(SEQ ID NO: 6072) Cys Glu Phe Cys Ser Asn Gly Ala Cys Thr Gly Cys Tyr
(SEQ ID NO: 6073) Cys Glu Phe Cys Ser Asn Gly Ala Cys Thr Ala Cys Tyr
(SEQ ID NO: 6074) Cys Glu Phe Cys Ser Asn Gly Ala Cys Val Gly Cys Tyr
(SEQ ID NO: 6075) Cys Glu Phe Cys Ser Asn Gly Ala Cys Val Ala Cys Tyr
(SEQ ID NO: 6076) Cys Glu Phe Cys Ser Asn Gly Ala Cys Gly Gly Cys Tyr
(SEQ ID NO: 6077) Cys Glu Phe Cys Ser Asn Gly Ala Cys Gly Ala Cys Tyr
(SEQ ID NO: 6078) Cys Glu Phe Cys Ser Asn Gly Thr Cys Thr Gly Cys Tyr
(SEQ ID NO: 6079) Cys Glu Phe Cys Ser Asn Gly Thr Cys Thr Ala Cys Tyr
(SEQ ID NO: 6080) Cys Glu Phe Cys Ser Asn Gly Thr Cys Val Gly Cys Tyr
(SEQ ID NO: 6081) Cys Glu Phe Cys Ser Asn Gly Thr Cys Val Ala Cys Tyr
(SEQ ID NO: 6082) Cys Glu Phe Cys Ser Asn Gly Thr Cys Gly Gly Cys Tyr
(SEQ ID NO: 6083) Cys Glu Phe Cys Ser Asn Gly Thr Cys Gly Ala Cys Tyr
(SEQ ID NO: 6084) Cys Glu Phe Cys Thr Asn Pro Ala Cys Thr Gly Cys Tyr
(SEQ ID NO: 6085) Cys Glu Phe Cys Thr Asn Pro Ala Cys Thr Ala Cys Tyr
(SEQ ID NO: 6086) Cys Glu Phe Cys Thr Asn Pro Ala Cys Val Gly Cys Tyr
(SEQ ID NO: 6087) Cys Glu Phe Cys Thr Asn Pro Ala Cys Val Ala Cys Tyr
(SEQ ID NO: 6088) Cys Glu Phe Cys Thr Asn Pro Ala Cys Gly Gly Cys Tyr
(SEQ ID NO: 6089) Cys Glu Phe Cys Thr Asn Pro Ala Cys Gly Ala Cys Tyr
(SEQ ID NO: 6090) Cys Glu Phe Cys Thr Asn Pro Thr Cys Thr Gly Cys Tyr
(SEQ ID NO: 6091) Cys Glu Phe Cys Thr Asn Pro Thr Cys Thr Ala Cys Tyr
(SEQ ID NO: 6092) Cys Glu Phe Cys Thr Asn Pro Thr Cys Val Gly Cys Tyr
(SEQ ID NO: 6093) Cys Glu Phe Cys Thr Asn Pro Thr Cys Val Ala Cys Tyr
(SEQ ID NO: 6094) Cys Glu Phe Cys Thr Asn Pro Thr Cys Gly Gly Cys Tyr
(SEQ ID NO: 6095) Cys Glu Phe Cys Thr Asn Pro Thr Cys Gly Ala Cys Tyr
(SEQ ID NO: 6096) Cys Glu Phe Cys Thr Asn Gly Ala Cys Thr Gly Cys Tyr

FIG. 3

| | |
|---|---|
| (SEQ ID NO: 6097) | Cys Glu Phe Cys Thr Asn Gly Ala Cys Thr Ala Cys Tyr |
| (SEQ ID NO: 6098) | Cys Glu Phe Cys Thr Asn Gly Ala Cys Val Gly Cys Tyr |
| (SEQ ID NO: 6099) | Cys Glu Phe Cys Thr Asn Gly Ala Cys Val Ala Cys Tyr |
| (SEQ ID NO: 6100) | Cys Glu Phe Cys Thr Asn Gly Ala Cys Gly Gly Cys Tyr |
| (SEQ ID NO: 6101) | Cys Glu Phe Cys Thr Asn Gly Ala Cys Gly Ala Cys Tyr |
| (SEQ ID NO: 6102) | Cys Glu Phe Cys Thr Asn Gly Thr Cys Thr Gly Cys Tyr |
| (SEQ ID NO: 6103) | Cys Glu Phe Cys Thr Asn Gly Thr Cys Thr Ala Cys Tyr |
| (SEQ ID NO: 6104) | Cys Glu Phe Cys Thr Asn Gly Thr Cys Val Gly Cys Tyr |
| (SEQ ID NO: 6105) | Cys Glu Phe Cys Thr Asn Gly Thr Cys Val Ala Cys Tyr |
| (SEQ ID NO: 6106) | Cys Glu Phe Cys Thr Asn Gly Thr Cys Gly Gly Cys Tyr |
| (SEQ ID NO: 6107) | Cys Glu Phe Cys Thr Asn Gly Thr Cys Gly Ala Cys Tyr |
| (SEQ ID NO: 6108) | Cys Glu Phe Cys Trp Asn Pro Ala Cys Thr Gly Cys Tyr |
| (SEQ ID NO: 6109) | Cys Glu Phe Cys Trp Asn Pro Ala Cys Thr Ala Cys Tyr |
| (SEQ ID NO: 6110) | Cys Glu Phe Cys Trp Asn Pro Ala Cys Val Gly Cys Tyr |
| (SEQ ID NO: 6111) | Cys Glu Phe Cys Trp Asn Pro Ala Cys Val Ala Cys Tyr |
| (SEQ ID NO: 6112) | Cys Glu Phe Cys Trp Asn Pro Ala Cys Gly Gly Cys Tyr |
| (SEQ ID NO: 6113) | Cys Glu Phe Cys Trp Asn Pro Ala Cys Gly Ala Cys Tyr |
| (SEQ ID NO: 6114) | Cys Glu Phe Cys Trp Asn Pro Thr Cys Thr Gly Cys Tyr |
| (SEQ ID NO: 6115) | Cys Glu Phe Cys Trp Asn Pro Thr Cys Thr Ala Cys Tyr |
| (SEQ ID NO: 6116) | Cys Glu Phe Cys Trp Asn Pro Thr Cys Val Gly Cys Tyr |
| (SEQ ID NO: 6117) | Cys Glu Phe Cys Trp Asn Pro Thr Cys Val Ala Cys Tyr |
| (SEQ ID NO: 6118) | Cys Glu Phe Cys Trp Asn Pro Thr Cys Gly Gly Cys Tyr |
| (SEQ ID NO: 6119) | Cys Glu Phe Cys Trp Asn Pro Thr Cys Gly Ala Cys Tyr |
| (SEQ ID NO: 6120) | Cys Glu Phe Cys Trp Asn Gly Ala Cys Thr Gly Cys Tyr |
| (SEQ ID NO: 6121) | Cys Glu Phe Cys Trp Asn Gly Ala Cys Thr Ala Cys Tyr |
| (SEQ ID NO: 6122) | Cys Glu Phe Cys Trp Asn Gly Ala Cys Val Gly Cys Tyr |
| (SEQ ID NO: 6123) | Cys Glu Phe Cys Trp Asn Gly Ala Cys Val Ala Cys Tyr |
| (SEQ ID NO: 6124) | Cys Glu Phe Cys Trp Asn Gly Ala Cys Gly Gly Cys Tyr |
| (SEQ ID NO: 6125) | Cys Glu Phe Cys Trp Asn Gly Ala Cys Gly Ala Cys Tyr |
| (SEQ ID NO: 6126) | Cys Glu Phe Cys Trp Asn Gly Thr Cys Thr Gly Cys Tyr |
| (SEQ ID NO: 6127) | Cys Glu Phe Cys Trp Asn Gly Thr Cys Thr Ala Cys Tyr |
| (SEQ ID NO: 6128) | Cys Glu Phe Cys Trp Asn Gly Thr Cys Val Gly Cys Tyr |
| (SEQ ID NO: 6129) | Cys Glu Phe Cys Trp Asn Gly Thr Cys Val Ala Cys Tyr |
| (SEQ ID NO: 6130) | Cys Glu Phe Cys Trp Asn Gly Thr Cys Gly Gly Cys Tyr |
| (SEQ ID NO: 6131) | Cys Glu Phe Cys Trp Asn Gly Thr Cys Gly Ala Cys Tyr |
| (SEQ ID NO: 6132) | Cys Glu Phe Cys Tyr Asn Pro Ala Cys Thr Gly Cys Tyr |
| (SEQ ID NO: 6133) | Cys Glu Phe Cys Tyr Asn Pro Ala Cys Thr Ala Cys Tyr |
| (SEQ ID NO: 6134) | Cys Glu Phe Cys Tyr Asn Pro Ala Cys Val Gly Cys Tyr |
| (SEQ ID NO: 6135) | Cys Glu Phe Cys Tyr Asn Pro Ala Cys Val Ala Cys Tyr |
| (SEQ ID NO: 6136) | Cys Glu Phe Cys Tyr Asn Pro Ala Cys Gly Gly Cys Tyr |
| (SEQ ID NO: 6137) | Cys Glu Phe Cys Tyr Asn Pro Ala Cys Gly Ala Cys Tyr |
| (SEQ ID NO: 6138) | Cys Glu Phe Cys Tyr Asn Pro Thr Cys Thr Gly Cys Tyr |
| (SEQ ID NO: 6139) | Cys Glu Phe Cys Tyr Asn Pro Thr Cys Thr Ala Cys Tyr |

FIG. 3

(SEQ ID NO: 6140)   Cys Glu Phe Cys Tyr Asn Pro Thr Cys Val Gly Cys Tyr
(SEQ ID NO: 6141)   Cys Glu Phe Cys Tyr Asn Pro Thr Cys Val Ala Cys Tyr
(SEQ ID NO: 6142)   Cys Glu Phe Cys Tyr Asn Pro Thr Cys Gly Gly Cys Tyr
(SEQ ID NO: 6143)   Cys Glu Phe Cys Tyr Asn Pro Thr Cys Gly Ala Cys Tyr
(SEQ ID NO: 6144)   Cys Glu Phe Cys Tyr Asn Gly Ala Cys Thr Gly Cys Tyr
(SEQ ID NO: 6145)   Cys Glu Phe Cys Tyr Asn Gly Ala Cys Thr Ala Cys Tyr
(SEQ ID NO: 6146)   Cys Glu Phe Cys Tyr Asn Gly Ala Cys Val Gly Cys Tyr
(SEQ ID NO: 6147)   Cys Glu Phe Cys Tyr Asn Gly Ala Cys Val Ala Cys Tyr
(SEQ ID NO: 6148)   Cys Glu Phe Cys Tyr Asn Gly Ala Cys Gly Gly Cys Tyr
(SEQ ID NO: 6149)   Cys Glu Phe Cys Tyr Asn Gly Ala Cys Gly Ala Cys Tyr
(SEQ ID NO: 6150)   Cys Glu Phe Cys Tyr Asn Gly Thr Cys Thr Gly Cys Tyr
(SEQ ID NO: 6151)   Cys Glu Phe Cys Tyr Asn Gly Thr Cys Thr Ala Cys Tyr
(SEQ ID NO: 6152)   Cys Glu Phe Cys Tyr Asn Gly Thr Cys Val Gly Cys Tyr
(SEQ ID NO: 6153)   Cys Glu Phe Cys Tyr Asn Gly Thr Cys Val Ala Cys Tyr
(SEQ ID NO: 6154)   Cys Glu Phe Cys Tyr Asn Gly Thr Cys Gly Gly Cys Tyr
(SEQ ID NO: 6155)   Cys Glu Phe Cys Tyr Asn Gly Thr Cys Gly Ala Cys Tyr
(SEQ ID NO: 6156)   Cys Glu Phe Cys Val Asn Pro Ala Cys Thr Gly Cys Tyr
(SEQ ID NO: 6157)   Cys Glu Phe Cys Val Asn Pro Ala Cys Thr Ala Cys Tyr
(SEQ ID NO: 6158)   Cys Glu Phe Cys Val Asn Pro Ala Cys Val Gly Cys Tyr
(SEQ ID NO: 6159)   Cys Glu Phe Cys Val Asn Pro Ala Cys Val Ala Cys Tyr
(SEQ ID NO: 6160)   Cys Glu Phe Cys Val Asn Pro Ala Cys Gly Gly Cys Tyr
(SEQ ID NO: 6161)   Cys Glu Phe Cys Val Asn Pro Ala Cys Gly Ala Cys Tyr
(SEQ ID NO: 6162)   Cys Glu Phe Cys Val Asn Pro Thr Cys Thr Gly Cys Tyr
(SEQ ID NO: 6163)   Cys Glu Phe Cys Val Asn Pro Thr Cys Thr Ala Cys Tyr
(SEQ ID NO: 6164)   Cys Glu Phe Cys Val Asn Pro Thr Cys Val Gly Cys Tyr
(SEQ ID NO: 6165)   Cys Glu Phe Cys Val Asn Pro Thr Cys Val Ala Cys Tyr
(SEQ ID NO: 6166)   Cys Glu Phe Cys Val Asn Pro Thr Cys Gly Gly Cys Tyr
(SEQ ID NO: 6167)   Cys Glu Phe Cys Val Asn Pro Thr Cys Gly Ala Cys Tyr
(SEQ ID NO: 6168)   Cys Glu Phe Cys Val Asn Gly Ala Cys Thr Gly Cys Tyr
(SEQ ID NO: 6169)   Cys Glu Phe Cys Val Asn Gly Ala Cys Thr Ala Cys Tyr
(SEQ ID NO: 6170)   Cys Glu Phe Cys Val Asn Gly Ala Cys Val Gly Cys Tyr
(SEQ ID NO: 6171)   Cys Glu Phe Cys Val Asn Gly Ala Cys Val Ala Cys Tyr
(SEQ ID NO: 6172)   Cys Glu Phe Cys Val Asn Gly Ala Cys Gly Gly Cys Tyr
(SEQ ID NO: 6173)   Cys Glu Phe Cys Val Asn Gly Ala Cys Gly Ala Cys Tyr
(SEQ ID NO: 6174)   Cys Glu Phe Cys Val Asn Gly Thr Cys Thr Gly Cys Tyr
(SEQ ID NO: 6175)   Cys Glu Phe Cys Val Asn Gly Thr Cys Thr Ala Cys Tyr
(SEQ ID NO: 6176)   Cys Glu Phe Cys Val Asn Gly Thr Cys Val Gly Cys Tyr
(SEQ ID NO: 6177)   Cys Glu Phe Cys Val Asn Gly Thr Cys Val Ala Cys Tyr
(SEQ ID NO: 6178)   Cys Glu Phe Cys Val Asn Gly Thr Cys Gly Gly Cys Tyr
(SEQ ID NO: 6179)   Cys Glu Phe Cys Val Asn Gly Thr Cys Gly Ala Cys Tyr
(SEQ ID NO: 6180)   Cys Glu Phe Cys --- Asn Pro Ala Cys Thr Gly Cys Tyr
(SEQ ID NO: 6181)   Cys Glu Phe Cys --- Asn Pro Ala Cys Thr Ala Cys Tyr
(SEQ ID NO: 6182)   Cys Glu Phe Cys --- Asn Pro Ala Cys Val Gly Cys Tyr

FIG. 3

| | |
|---|---|
| (SEQ ID NO: 6183) | Cys Glu Phe Cys --- Asn Pro Ala Cys Val Ala Cys Tyr |
| (SEQ ID NO: 6184) | Cys Glu Phe Cys --- Asn Pro Ala Cys Gly Gly Cys Tyr |
| (SEQ ID NO: 6185) | Cys Glu Phe Cys --- Asn Pro Ala Cys Gly Ala Cys Tyr |
| (SEQ ID NO: 6186) | Cys Glu Phe Cys --- Asn Pro Thr Cys Thr Gly Cys Tyr |
| (SEQ ID NO: 6187) | Cys Glu Phe Cys --- Asn Pro Thr Cys Thr Ala Cys Tyr |
| (SEQ ID NO: 6188) | Cys Glu Phe Cys --- Asn Pro Thr Cys Val Gly Cys Tyr |
| (SEQ ID NO: 6189) | Cys Glu Phe Cys --- Asn Pro Thr Cys Val Ala Cys Tyr |
| (SEQ ID NO: 6190) | Cys Glu Phe Cys --- Asn Pro Thr Cys Gly Gly Cys Tyr |
| (SEQ ID NO: 6191) | Cys Glu Phe Cys --- Asn Pro Thr Cys Gly Ala Cys Tyr |
| (SEQ ID NO: 6192) | Cys Glu Phe Cys --- Asn Gly Ala Cys Thr Gly Cys Tyr |
| (SEQ ID NO: 6193) | Cys Glu Phe Cys --- Asn Gly Ala Cys Thr Ala Cys Tyr |
| (SEQ ID NO: 6194) | Cys Glu Phe Cys --- Asn Gly Ala Cys Val Gly Cys Tyr |
| (SEQ ID NO: 6195) | Cys Glu Phe Cys --- Asn Gly Ala Cys Val Ala Cys Tyr |
| (SEQ ID NO: 6196) | Cys Glu Phe Cys --- Asn Gly Ala Cys Gly Gly Cys Tyr |
| (SEQ ID NO: 6197) | Cys Glu Phe Cys --- Asn Gly Ala Cys Gly Ala Cys Tyr |
| (SEQ ID NO: 6198) | Cys Glu Phe Cys --- Asn Gly Thr Cys Thr Gly Cys Tyr |
| (SEQ ID NO: 6199) | Cys Glu Phe Cys --- Asn Gly Thr Cys Thr Ala Cys Tyr |
| (SEQ ID NO: 6200) | Cys Glu Phe Cys --- Asn Gly Thr Cys Val Gly Cys Tyr |
| (SEQ ID NO: 6201) | Cys Glu Phe Cys --- Asn Gly Thr Cys Val Ala Cys Tyr |
| (SEQ ID NO: 6202) | Cys Glu Phe Cys --- Asn Gly Thr Cys Gly Gly Cys Tyr |
| (SEQ ID NO: 6203) | Cys Glu Phe Cys --- Asn Gly Thr Cys Gly Ala Cys Tyr |
| (SEQ ID NO: 6204) | Cys Glu Leu Cys Ala Asn Pro Ala Cys Thr Gly Cys Tyr |
| (SEQ ID NO: 6205) | Cys Glu Leu Cys Ala Asn Pro Ala Cys Thr Ala Cys Tyr |
| (SEQ ID NO: 6206) | Cys Glu Leu Cys Ala Asn Pro Ala Cys Val Gly Cys Tyr |
| (SEQ ID NO: 6207) | Cys Glu Leu Cys Ala Asn Pro Ala Cys Val Ala Cys Tyr |
| (SEQ ID NO: 6208) | Cys Glu Leu Cys Ala Asn Pro Ala Cys Gly Gly Cys Tyr |
| (SEQ ID NO: 6209) | Cys Glu Leu Cys Ala Asn Pro Ala Cys Gly Ala Cys Tyr |
| (SEQ ID NO: 6210) | Cys Glu Leu Cys Ala Asn Pro Thr Cys Thr Gly Cys Tyr |
| (SEQ ID NO: 6211) | Cys Glu Leu Cys Ala Asn Pro Thr Cys Thr Ala Cys Tyr |
| (SEQ ID NO: 6212) | Cys Glu Leu Cys Ala Asn Pro Thr Cys Val Gly Cys Tyr |
| (SEQ ID NO: 6213) | Cys Glu Leu Cys Ala Asn Pro Thr Cys Val Ala Cys Tyr |
| (SEQ ID NO: 6214) | Cys Glu Leu Cys Ala Asn Pro Thr Cys Gly Gly Cys Tyr |
| (SEQ ID NO: 6215) | Cys Glu Leu Cys Ala Asn Pro Thr Cys Gly Ala Cys Tyr |
| (SEQ ID NO: 6216) | Cys Glu Leu Cys Ala Asn Gly Ala Cys Thr Gly Cys Tyr |
| (SEQ ID NO: 6217) | Cys Glu Leu Cys Ala Asn Gly Ala Cys Thr Ala Cys Tyr |
| (SEQ ID NO: 6218) | Cys Glu Leu Cys Ala Asn Gly Ala Cys Val Gly Cys Tyr |
| (SEQ ID NO: 6219) | Cys Glu Leu Cys Ala Asn Gly Ala Cys Val Ala Cys Tyr |
| (SEQ ID NO: 6220) | Cys Glu Leu Cys Ala Asn Gly Ala Cys Gly Gly Cys Tyr |
| (SEQ ID NO: 6221) | Cys Glu Leu Cys Ala Asn Gly Ala Cys Gly Ala Cys Tyr |
| (SEQ ID NO: 6222) | Cys Glu Leu Cys Ala Asn Gly Thr Cys Thr Gly Cys Tyr |
| (SEQ ID NO: 6223) | Cys Glu Leu Cys Ala Asn Gly Thr Cys Thr Ala Cys Tyr |
| (SEQ ID NO: 6224) | Cys Glu Leu Cys Ala Asn Gly Thr Cys Val Gly Cys Tyr |
| (SEQ ID NO: 6225) | Cys Glu Leu Cys Ala Asn Gly Thr Cys Val Ala Cys Tyr |

FIG. 3

| | |
|---|---|
| (SEQ ID NO: 6226) | Cys Glu Leu Cys Ala Asn Gly Thr Cys Gly Gly Cys Tyr |
| (SEQ ID NO: 6227) | Cys Glu Leu Cys Ala Asn Gly Thr Cys Gly Ala Cys Tyr |
| (SEQ ID NO: 6228) | Cys Glu Leu Cys Arg Asn Pro Ala Cys Thr Gly Cys Tyr |
| (SEQ ID NO: 6229) | Cys Glu Leu Cys Arg Asn Pro Ala Cys Thr Ala Cys Tyr |
| (SEQ ID NO: 6230) | Cys Glu Leu Cys Arg Asn Pro Ala Cys Val Gly Cys Tyr |
| (SEQ ID NO: 6231) | Cys Glu Leu Cys Arg Asn Pro Ala Cys Val Ala Cys Tyr |
| (SEQ ID NO: 6232) | Cys Glu Leu Cys Arg Asn Pro Ala Cys Gly Gly Cys Tyr |
| (SEQ ID NO: 6233) | Cys Glu Leu Cys Arg Asn Pro Ala Cys Gly Ala Cys Tyr |
| (SEQ ID NO: 6234) | Cys Glu Leu Cys Arg Asn Pro Thr Cys Thr Gly Cys Tyr |
| (SEQ ID NO: 6235) | Cys Glu Leu Cys Arg Asn Pro Thr Cys Thr Ala Cys Tyr |
| (SEQ ID NO: 6236) | Cys Glu Leu Cys Arg Asn Pro Thr Cys Val Gly Cys Tyr |
| (SEQ ID NO: 6237) | Cys Glu Leu Cys Arg Asn Pro Thr Cys Val Ala Cys Tyr |
| (SEQ ID NO: 6238) | Cys Glu Leu Cys Arg Asn Pro Thr Cys Gly Gly Cys Tyr |
| (SEQ ID NO: 6239) | Cys Glu Leu Cys Arg Asn Pro Thr Cys Gly Ala Cys Tyr |
| (SEQ ID NO: 6240) | Cys Glu Leu Cys Arg Asn Gly Ala Cys Thr Gly Cys Tyr |
| (SEQ ID NO: 6241) | Cys Glu Leu Cys Arg Asn Gly Ala Cys Thr Ala Cys Tyr |
| (SEQ ID NO: 6242) | Cys Glu Leu Cys Arg Asn Gly Ala Cys Val Gly Cys Tyr |
| (SEQ ID NO: 6243) | Cys Glu Leu Cys Arg Asn Gly Ala Cys Val Ala Cys Tyr |
| (SEQ ID NO: 6244) | Cys Glu Leu Cys Arg Asn Gly Ala Cys Gly Gly Cys Tyr |
| (SEQ ID NO: 6245) | Cys Glu Leu Cys Arg Asn Gly Ala Cys Gly Ala Cys Tyr |
| (SEQ ID NO: 6246) | Cys Glu Leu Cys Arg Asn Gly Thr Cys Thr Gly Cys Tyr |
| (SEQ ID NO: 6247) | Cys Glu Leu Cys Arg Asn Gly Thr Cys Thr Ala Cys Tyr |
| (SEQ ID NO: 6248) | Cys Glu Leu Cys Arg Asn Gly Thr Cys Val Gly Cys Tyr |
| (SEQ ID NO: 6249) | Cys Glu Leu Cys Arg Asn Gly Thr Cys Val Ala Cys Tyr |
| (SEQ ID NO: 6250) | Cys Glu Leu Cys Arg Asn Gly Thr Cys Gly Gly Cys Tyr |
| (SEQ ID NO: 6251) | Cys Glu Leu Cys Arg Asn Gly Thr Cys Gly Ala Cys Tyr |
| (SEQ ID NO: 6252) | Cys Glu Leu Cys Asn Asn Pro Ala Cys Thr Gly Cys Tyr |
| (SEQ ID NO: 6253) | Cys Glu Leu Cys Asn Asn Pro Ala Cys Thr Ala Cys Tyr |
| (SEQ ID NO: 6254) | Cys Glu Leu Cys Asn Asn Pro Ala Cys Val Gly Cys Tyr |
| (SEQ ID NO: 6255) | Cys Glu Leu Cys Asn Asn Pro Ala Cys Val Ala Cys Tyr |
| (SEQ ID NO: 6256) | Cys Glu Leu Cys Asn Asn Pro Ala Cys Gly Gly Cys Tyr |
| (SEQ ID NO: 6257) | Cys Glu Leu Cys Asn Asn Pro Ala Cys Gly Ala Cys Tyr |
| (SEQ ID NO: 6258) | Cys Glu Leu Cys Asn Asn Pro Thr Cys Thr Gly Cys Tyr |
| (SEQ ID NO: 6259) | Cys Glu Leu Cys Asn Asn Pro Thr Cys Thr Ala Cys Tyr |
| (SEQ ID NO: 6260) | Cys Glu Leu Cys Asn Asn Pro Thr Cys Val Gly Cys Tyr |
| (SEQ ID NO: 6261) | Cys Glu Leu Cys Asn Asn Pro Thr Cys Val Ala Cys Tyr |
| (SEQ ID NO: 6262) | Cys Glu Leu Cys Asn Asn Pro Thr Cys Gly Gly Cys Tyr |
| (SEQ ID NO: 6263) | Cys Glu Leu Cys Asn Asn Pro Thr Cys Gly Ala Cys Tyr |
| (SEQ ID NO: 6264) | Cys Glu Leu Cys Asn Asn Gly Ala Cys Thr Gly Cys Tyr |
| (SEQ ID NO: 6265) | Cys Glu Leu Cys Asn Asn Gly Ala Cys Thr Ala Cys Tyr |
| (SEQ ID NO: 6266) | Cys Glu Leu Cys Asn Asn Gly Ala Cys Val Gly Cys Tyr |
| (SEQ ID NO: 6267) | Cys Glu Leu Cys Asn Asn Gly Ala Cys Val Ala Cys Tyr |
| (SEQ ID NO: 6268) | Cys Glu Leu Cys Asn Asn Gly Ala Cys Gly Gly Cys Tyr |

FIG. 3

(SEQ ID NO: 6269) Cys Glu Leu Cys Asn Asn Gly Ala Cys Gly Ala Cys Tyr
(SEQ ID NO: 6270) Cys Glu Leu Cys Asn Asn Gly Thr Cys Thr Gly Cys Tyr
(SEQ ID NO: 6271) Cys Glu Leu Cys Asn Asn Gly Thr Cys Thr Ala Cys Tyr
(SEQ ID NO: 6272) Cys Glu Leu Cys Asn Asn Gly Thr Cys Val Gly Cys Tyr
(SEQ ID NO: 6273) Cys Glu Leu Cys Asn Asn Gly Thr Cys Val Ala Cys Tyr
(SEQ ID NO: 6274) Cys Glu Leu Cys Asn Asn Gly Thr Cys Gly Gly Cys Tyr
(SEQ ID NO: 6275) Cys Glu Leu Cys Asn Asn Gly Thr Cys Gly Ala Cys Tyr
(SEQ ID NO: 6276) Cys Glu Leu Cys Asp Asn Pro Ala Cys Thr Gly Cys Tyr
(SEQ ID NO: 6277) Cys Glu Leu Cys Asp Asn Pro Ala Cys Thr Ala Cys Tyr
(SEQ ID NO: 6278) Cys Glu Leu Cys Asp Asn Pro Ala Cys Val Gly Cys Tyr
(SEQ ID NO: 6279) Cys Glu Leu Cys Asp Asn Pro Ala Cys Val Ala Cys Tyr
(SEQ ID NO: 6280) Cys Glu Leu Cys Asp Asn Pro Ala Cys Gly Gly Cys Tyr
(SEQ ID NO: 6281) Cys Glu Leu Cys Asp Asn Pro Ala Cys Gly Ala Cys Tyr
(SEQ ID NO: 6282) Cys Glu Leu Cys Asp Asn Pro Thr Cys Thr Gly Cys Tyr
(SEQ ID NO: 6283) Cys Glu Leu Cys Asp Asn Pro Thr Cys Thr Ala Cys Tyr
(SEQ ID NO: 6284) Cys Glu Leu Cys Asp Asn Pro Thr Cys Val Gly Cys Tyr
(SEQ ID NO: 6285) Cys Glu Leu Cys Asp Asn Pro Thr Cys Val Ala Cys Tyr
(SEQ ID NO: 6286) Cys Glu Leu Cys Asp Asn Pro Thr Cys Gly Gly Cys Tyr
(SEQ ID NO: 6287) Cys Glu Leu Cys Asp Asn Pro Thr Cys Gly Ala Cys Tyr
(SEQ ID NO: 6288) Cys Glu Leu Cys Asp Asn Gly Ala Cys Thr Gly Cys Tyr
(SEQ ID NO: 6289) Cys Glu Leu Cys Asp Asn Gly Ala Cys Thr Ala Cys Tyr
(SEQ ID NO: 6290) Cys Glu Leu Cys Asp Asn Gly Ala Cys Val Gly Cys Tyr
(SEQ ID NO: 6291) Cys Glu Leu Cys Asp Asn Gly Ala Cys Val Ala Cys Tyr
(SEQ ID NO: 6292) Cys Glu Leu Cys Asp Asn Gly Ala Cys Gly Gly Cys Tyr
(SEQ ID NO: 6293) Cys Glu Leu Cys Asp Asn Gly Ala Cys Gly Ala Cys Tyr
(SEQ ID NO: 6294) Cys Glu Leu Cys Asp Asn Gly Thr Cys Thr Gly Cys Tyr
(SEQ ID NO: 6295) Cys Glu Leu Cys Asp Asn Gly Thr Cys Thr Ala Cys Tyr
(SEQ ID NO: 6296) Cys Glu Leu Cys Asp Asn Gly Thr Cys Val Gly Cys Tyr
(SEQ ID NO: 6297) Cys Glu Leu Cys Asp Asn Gly Thr Cys Val Ala Cys Tyr
(SEQ ID NO: 6298) Cys Glu Leu Cys Asp Asn Gly Thr Cys Gly Gly Cys Tyr
(SEQ ID NO: 6299) Cys Glu Leu Cys Asp Asn Gly Thr Cys Gly Ala Cys Tyr
(SEQ ID NO: 6300) Cys Glu Leu Cys Gln Asn Pro Ala Cys Thr Gly Cys Tyr
(SEQ ID NO: 6301) Cys Glu Leu Cys Gln Asn Pro Ala Cys Thr Ala Cys Tyr
(SEQ ID NO: 6302) Cys Glu Leu Cys Gln Asn Pro Ala Cys Val Gly Cys Tyr
(SEQ ID NO: 6303) Cys Glu Leu Cys Gln Asn Pro Ala Cys Val Ala Cys Tyr
(SEQ ID NO: 6304) Cys Glu Leu Cys Gln Asn Pro Ala Cys Gly Gly Cys Tyr
(SEQ ID NO: 6305) Cys Glu Leu Cys Gln Asn Pro Ala Cys Gly Ala Cys Tyr
(SEQ ID NO: 6306) Cys Glu Leu Cys Gln Asn Pro Thr Cys Thr Gly Cys Tyr
(SEQ ID NO: 6307) Cys Glu Leu Cys Gln Asn Pro Thr Cys Thr Ala Cys Tyr
(SEQ ID NO: 6308) Cys Glu Leu Cys Gln Asn Pro Thr Cys Val Gly Cys Tyr
(SEQ ID NO: 6309) Cys Glu Leu Cys Gln Asn Pro Thr Cys Val Ala Cys Tyr
(SEQ ID NO: 6310) Cys Glu Leu Cys Gln Asn Pro Thr Cys Gly Gly Cys Tyr
(SEQ ID NO: 6311) Cys Glu Leu Cys Gln Asn Pro Thr Cys Gly Ala Cys Tyr

| SEQ ID NO | Sequence |
|---|---|
| 6312 | Cys Glu Leu Cys Gln Asn Gly Ala Cys Thr Gly Cys Tyr |
| 6313 | Cys Glu Leu Cys Gln Asn Gly Ala Cys Thr Ala Cys Tyr |
| 6314 | Cys Glu Leu Cys Gln Asn Gly Ala Cys Val Gly Cys Tyr |
| 6315 | Cys Glu Leu Cys Gln Asn Gly Ala Cys Val Ala Cys Tyr |
| 6316 | Cys Glu Leu Cys Gln Asn Gly Ala Cys Gly Gly Cys Tyr |
| 6317 | Cys Glu Leu Cys Gln Asn Gly Ala Cys Gly Ala Cys Tyr |
| 6318 | Cys Glu Leu Cys Gln Asn Gly Thr Cys Thr Gly Cys Tyr |
| 6319 | Cys Glu Leu Cys Gln Asn Gly Thr Cys Thr Ala Cys Tyr |
| 6320 | Cys Glu Leu Cys Gln Asn Gly Thr Cys Val Gly Cys Tyr |
| 6321 | Cys Glu Leu Cys Gln Asn Gly Thr Cys Val Ala Cys Tyr |
| 6322 | Cys Glu Leu Cys Gln Asn Gly Thr Cys Gly Gly Cys Tyr |
| 6323 | Cys Glu Leu Cys Gln Asn Gly Thr Cys Gly Ala Cys Tyr |
| 6324 | Cys Glu Leu Cys Glu Asn Pro Ala Cys Thr Gly Cys Tyr |
| 6325 | Cys Glu Leu Cys Glu Asn Pro Ala Cys Thr Ala Cys Tyr |
| 6326 | Cys Glu Leu Cys Glu Asn Pro Ala Cys Val Gly Cys Tyr |
| 6327 | Cys Glu Leu Cys Glu Asn Pro Ala Cys Val Ala Cys Tyr |
| 6328 | Cys Glu Leu Cys Glu Asn Pro Ala Cys Gly Gly Cys Tyr |
| 6329 | Cys Glu Leu Cys Glu Asn Pro Ala Cys Gly Ala Cys Tyr |
| 6330 | Cys Glu Leu Cys Glu Asn Pro Thr Cys Thr Gly Cys Tyr |
| 6331 | Cys Glu Leu Cys Glu Asn Pro Thr Cys Thr Ala Cys Tyr |
| 6332 | Cys Glu Leu Cys Glu Asn Pro Thr Cys Val Gly Cys Tyr |
| 6333 | Cys Glu Leu Cys Glu Asn Pro Thr Cys Val Ala Cys Tyr |
| 6334 | Cys Glu Leu Cys Glu Asn Pro Thr Cys Gly Gly Cys Tyr |
| 6335 | Cys Glu Leu Cys Glu Asn Pro Thr Cys Gly Ala Cys Tyr |
| 6336 | Cys Glu Leu Cys Glu Asn Gly Ala Cys Thr Gly Cys Tyr |
| 6337 | Cys Glu Leu Cys Glu Asn Gly Ala Cys Thr Ala Cys Tyr |
| 6338 | Cys Glu Leu Cys Glu Asn Gly Ala Cys Val Gly Cys Tyr |
| 6339 | Cys Glu Leu Cys Glu Asn Gly Ala Cys Val Ala Cys Tyr |
| 6340 | Cys Glu Leu Cys Glu Asn Gly Ala Cys Gly Gly Cys Tyr |
| 6341 | Cys Glu Leu Cys Glu Asn Gly Ala Cys Gly Ala Cys Tyr |
| 6342 | Cys Glu Leu Cys Glu Asn Gly Thr Cys Thr Gly Cys Tyr |
| 6343 | Cys Glu Leu Cys Glu Asn Gly Thr Cys Thr Ala Cys Tyr |
| 6344 | Cys Glu Leu Cys Glu Asn Gly Thr Cys Val Gly Cys Tyr |
| 6345 | Cys Glu Leu Cys Glu Asn Gly Thr Cys Val Ala Cys Tyr |
| 6346 | Cys Glu Leu Cys Glu Asn Gly Thr Cys Gly Gly Cys Tyr |
| 6347 | Cys Glu Leu Cys Glu Asn Gly Thr Cys Gly Ala Cys Tyr |
| 6348 | Cys Glu Leu Cys Gly Asn Pro Ala Cys Thr Gly Cys Tyr |
| 6349 | Cys Glu Leu Cys Gly Asn Pro Ala Cys Thr Ala Cys Tyr |
| 6350 | Cys Glu Leu Cys Gly Asn Pro Ala Cys Val Gly Cys Tyr |
| 6351 | Cys Glu Leu Cys Gly Asn Pro Ala Cys Val Ala Cys Tyr |
| 6352 | Cys Glu Leu Cys Gly Asn Pro Ala Cys Gly Gly Cys Tyr |
| 6353 | Cys Glu Leu Cys Gly Asn Pro Ala Cys Gly Ala Cys Tyr |
| 6354 | Cys Glu Leu Cys Gly Asn Pro Thr Cys Thr Gly Cys Tyr |

| | |
|---|---|
| (SEQ ID NO: 6355) | Cys Glu Leu Cys Gly Asn Pro Thr Cys Thr Ala Cys Tyr |
| (SEQ ID NO: 6356) | Cys Glu Leu Cys Gly Asn Pro Thr Cys Val Gly Cys Tyr |
| (SEQ ID NO: 6357) | Cys Glu Leu Cys Gly Asn Pro Thr Cys Val Ala Cys Tyr |
| (SEQ ID NO: 6358) | Cys Glu Leu Cys Gly Asn Pro Thr Cys Gly Gly Cys Tyr |
| (SEQ ID NO: 6359) | Cys Glu Leu Cys Gly Asn Pro Thr Cys Gly Ala Cys Tyr |
| (SEQ ID NO: 6360) | Cys Glu Leu Cys Gly Asn Gly Ala Cys Thr Gly Cys Tyr |
| (SEQ ID NO: 6361) | Cys Glu Leu Cys Gly Asn Gly Ala Cys Thr Ala Cys Tyr |
| (SEQ ID NO: 6362) | Cys Glu Leu Cys Gly Asn Gly Ala Cys Val Gly Cys Tyr |
| (SEQ ID NO: 6363) | Cys Glu Leu Cys Gly Asn Gly Ala Cys Val Ala Cys Tyr |
| (SEQ ID NO: 6364) | Cys Glu Leu Cys Gly Asn Gly Ala Cys Gly Gly Cys Tyr |
| (SEQ ID NO: 6365) | Cys Glu Leu Cys Gly Asn Gly Ala Cys Gly Ala Cys Tyr |
| (SEQ ID NO: 6366) | Cys Glu Leu Cys Gly Asn Gly Thr Cys Thr Gly Cys Tyr |
| (SEQ ID NO: 6367) | Cys Glu Leu Cys Gly Asn Gly Thr Cys Thr Ala Cys Tyr |
| (SEQ ID NO: 6368) | Cys Glu Leu Cys Gly Asn Gly Thr Cys Val Gly Cys Tyr |
| (SEQ ID NO: 6369) | Cys Glu Leu Cys Gly Asn Gly Thr Cys Val Ala Cys Tyr |
| (SEQ ID NO: 6370) | Cys Glu Leu Cys Gly Asn Gly Thr Cys Gly Gly Cys Tyr |
| (SEQ ID NO: 6371) | Cys Glu Leu Cys Gly Asn Gly Thr Cys Gly Ala Cys Tyr |
| (SEQ ID NO: 6372) | Cys Glu Leu Cys His Asn Pro Ala Cys Thr Gly Cys Tyr |
| (SEQ ID NO: 6373) | Cys Glu Leu Cys His Asn Pro Ala Cys Thr Ala Cys Tyr |
| (SEQ ID NO: 6374) | Cys Glu Leu Cys His Asn Pro Ala Cys Val Gly Cys Tyr |
| (SEQ ID NO: 6375) | Cys Glu Leu Cys His Asn Pro Ala Cys Val Ala Cys Tyr |
| (SEQ ID NO: 6376) | Cys Glu Leu Cys His Asn Pro Ala Cys Gly Gly Cys Tyr |
| (SEQ ID NO: 6377) | Cys Glu Leu Cys His Asn Pro Ala Cys Gly Ala Cys Tyr |
| (SEQ ID NO: 6378) | Cys Glu Leu Cys His Asn Pro Thr Cys Thr Gly Cys Tyr |
| (SEQ ID NO: 6379) | Cys Glu Leu Cys His Asn Pro Thr Cys Thr Ala Cys Tyr |
| (SEQ ID NO: 6380) | Cys Glu Leu Cys His Asn Pro Thr Cys Val Gly Cys Tyr |
| (SEQ ID NO: 6381) | Cys Glu Leu Cys His Asn Pro Thr Cys Val Ala Cys Tyr |
| (SEQ ID NO: 6382) | Cys Glu Leu Cys His Asn Pro Thr Cys Gly Gly Cys Tyr |
| (SEQ ID NO: 6383) | Cys Glu Leu Cys His Asn Pro Thr Cys Gly Ala Cys Tyr |
| (SEQ ID NO: 6384) | Cys Glu Leu Cys His Asn Gly Ala Cys Thr Gly Cys Tyr |
| (SEQ ID NO: 6385) | Cys Glu Leu Cys His Asn Gly Ala Cys Thr Ala Cys Tyr |
| (SEQ ID NO: 6386) | Cys Glu Leu Cys His Asn Gly Ala Cys Val Gly Cys Tyr |
| (SEQ ID NO: 6387) | Cys Glu Leu Cys His Asn Gly Ala Cys Val Ala Cys Tyr |
| (SEQ ID NO: 6388) | Cys Glu Leu Cys His Asn Gly Ala Cys Gly Gly Cys Tyr |
| (SEQ ID NO: 6389) | Cys Glu Leu Cys His Asn Gly Ala Cys Gly Ala Cys Tyr |
| (SEQ ID NO: 6390) | Cys Glu Leu Cys His Asn Gly Thr Cys Thr Gly Cys Tyr |
| (SEQ ID NO: 6391) | Cys Glu Leu Cys His Asn Gly Thr Cys Thr Ala Cys Tyr |
| (SEQ ID NO: 6392) | Cys Glu Leu Cys His Asn Gly Thr Cys Val Gly Cys Tyr |
| (SEQ ID NO: 6393) | Cys Glu Leu Cys His Asn Gly Thr Cys Val Ala Cys Tyr |
| (SEQ ID NO: 6394) | Cys Glu Leu Cys His Asn Gly Thr Cys Gly Gly Cys Tyr |
| (SEQ ID NO: 6395) | Cys Glu Leu Cys His Asn Gly Thr Cys Gly Ala Cys Tyr |
| (SEQ ID NO: 6396) | Cys Glu Leu Cys Ile Asn Pro Ala Cys Thr Gly Cys Tyr |
| (SEQ ID NO: 6397) | Cys Glu Leu Cys Ile Asn Pro Ala Cys Thr Ala Cys Tyr |

FIG. 3

(SEQ ID NO: 6398) Cys Glu Leu Cys Ile Asn Pro Ala Cys Val Gly Cys Tyr
(SEQ ID NO: 6399) Cys Glu Leu Cys Ile Asn Pro Ala Cys Val Ala Cys Tyr
(SEQ ID NO: 6400) Cys Glu Leu Cys Ile Asn Pro Ala Cys Gly Gly Cys Tyr
(SEQ ID NO: 6401) Cys Glu Leu Cys Ile Asn Pro Ala Cys Gly Ala Cys Tyr
(SEQ ID NO: 6402) Cys Glu Leu Cys Ile Asn Pro Thr Cys Thr Gly Cys Tyr
(SEQ ID NO: 6403) Cys Glu Leu Cys Ile Asn Pro Thr Cys Thr Ala Cys Tyr
(SEQ ID NO: 6404) Cys Glu Leu Cys Ile Asn Pro Thr Cys Val Gly Cys Tyr
(SEQ ID NO: 6405) Cys Glu Leu Cys Ile Asn Pro Thr Cys Val Ala Cys Tyr
(SEQ ID NO: 6406) Cys Glu Leu Cys Ile Asn Pro Thr Cys Gly Gly Cys Tyr
(SEQ ID NO: 6407) Cys Glu Leu Cys Ile Asn Pro Thr Cys Gly Ala Cys Tyr
(SEQ ID NO: 6408) Cys Glu Leu Cys Ile Asn Gly Ala Cys Thr Gly Cys Tyr
(SEQ ID NO: 6409) Cys Glu Leu Cys Ile Asn Gly Ala Cys Thr Ala Cys Tyr
(SEQ ID NO: 6410) Cys Glu Leu Cys Ile Asn Gly Ala Cys Val Gly Cys Tyr
(SEQ ID NO: 6411) Cys Glu Leu Cys Ile Asn Gly Ala Cys Val Ala Cys Tyr
(SEQ ID NO: 6412) Cys Glu Leu Cys Ile Asn Gly Ala Cys Gly Gly Cys Tyr
(SEQ ID NO: 6413) Cys Glu Leu Cys Ile Asn Gly Ala Cys Gly Ala Cys Tyr
(SEQ ID NO: 6414) Cys Glu Leu Cys Ile Asn Gly Thr Cys Thr Gly Cys Tyr
(SEQ ID NO: 6415) Cys Glu Leu Cys Ile Asn Gly Thr Cys Thr Ala Cys Tyr
(SEQ ID NO: 6416) Cys Glu Leu Cys Ile Asn Gly Thr Cys Val Gly Cys Tyr
(SEQ ID NO: 6417) Cys Glu Leu Cys Ile Asn Gly Thr Cys Val Ala Cys Tyr
(SEQ ID NO: 6418) Cys Glu Leu Cys Ile Asn Gly Thr Cys Gly Gly Cys Tyr
(SEQ ID NO: 6419) Cys Glu Leu Cys Ile Asn Gly Thr Cys Gly Ala Cys Tyr
(SEQ ID NO: 6420) Cys Glu Leu Cys Leu Asn Pro Ala Cys Thr Gly Cys Tyr
(SEQ ID NO: 6421) Cys Glu Leu Cys Leu Asn Pro Ala Cys Thr Ala Cys Tyr
(SEQ ID NO: 6422) Cys Glu Leu Cys Leu Asn Pro Ala Cys Val Gly Cys Tyr
(SEQ ID NO: 6423) Cys Glu Leu Cys Leu Asn Pro Ala Cys Val Ala Cys Tyr
(SEQ ID NO: 6424) Cys Glu Leu Cys Leu Asn Pro Ala Cys Gly Gly Cys Tyr
(SEQ ID NO: 6425) Cys Glu Leu Cys Leu Asn Pro Ala Cys Gly Ala Cys Tyr
(SEQ ID NO: 6426) Cys Glu Leu Cys Leu Asn Pro Thr Cys Thr Gly Cys Tyr
(SEQ ID NO: 6427) Cys Glu Leu Cys Leu Asn Pro Thr Cys Thr Ala Cys Tyr
(SEQ ID NO: 6428) Cys Glu Leu Cys Leu Asn Pro Thr Cys Val Gly Cys Tyr
(SEQ ID NO: 6429) Cys Glu Leu Cys Leu Asn Pro Thr Cys Val Ala Cys Tyr
(SEQ ID NO: 6430) Cys Glu Leu Cys Leu Asn Pro Thr Cys Gly Gly Cys Tyr
(SEQ ID NO: 6431) Cys Glu Leu Cys Leu Asn Pro Thr Cys Gly Ala Cys Tyr
(SEQ ID NO: 6432) Cys Glu Leu Cys Leu Asn Gly Ala Cys Thr Gly Cys Tyr
(SEQ ID NO: 6433) Cys Glu Leu Cys Leu Asn Gly Ala Cys Thr Ala Cys Tyr
(SEQ ID NO: 6434) Cys Glu Leu Cys Leu Asn Gly Ala Cys Val Gly Cys Tyr
(SEQ ID NO: 6435) Cys Glu Leu Cys Leu Asn Gly Ala Cys Val Ala Cys Tyr
(SEQ ID NO: 6436) Cys Glu Leu Cys Leu Asn Gly Ala Cys Gly Gly Cys Tyr
(SEQ ID NO: 6437) Cys Glu Leu Cys Leu Asn Gly Ala Cys Gly Ala Cys Tyr
(SEQ ID NO: 6438) Cys Glu Leu Cys Leu Asn Gly Thr Cys Thr Gly Cys Tyr
(SEQ ID NO: 6439) Cys Glu Leu Cys Leu Asn Gly Thr Cys Thr Ala Cys Tyr
(SEQ ID NO: 6440) Cys Glu Leu Cys Leu Asn Gly Thr Cys Val Gly Cys Tyr

FIG. 3

(SEQ ID NO: 6441) Cys Glu Leu Cys Leu Asn Gly Thr Cys Val Ala Cys Tyr
(SEQ ID NO: 6442) Cys Glu Leu Cys Leu Asn Gly Thr Cys Gly Gly Cys Tyr
(SEQ ID NO: 6443) Cys Glu Leu Cys Leu Asn Gly Thr Cys Gly Ala Cys Tyr
(SEQ ID NO: 6444) Cys Glu Leu Cys Lys Asn Pro Ala Cys Thr Gly Cys Tyr
(SEQ ID NO: 6445) Cys Glu Leu Cys Lys Asn Pro Ala Cys Thr Ala Cys Tyr
(SEQ ID NO: 6446) Cys Glu Leu Cys Lys Asn Pro Ala Cys Val Gly Cys Tyr
(SEQ ID NO: 6447) Cys Glu Leu Cys Lys Asn Pro Ala Cys Val Ala Cys Tyr
(SEQ ID NO: 6448) Cys Glu Leu Cys Lys Asn Pro Ala Cys Gly Gly Cys Tyr
(SEQ ID NO: 6449) Cys Glu Leu Cys Lys Asn Pro Ala Cys Gly Ala Cys Tyr
(SEQ ID NO: 6450) Cys Glu Leu Cys Lys Asn Pro Thr Cys Thr Gly Cys Tyr
(SEQ ID NO: 6451) Cys Glu Leu Cys Lys Asn Pro Thr Cys Thr Ala Cys Tyr
(SEQ ID NO: 6452) Cys Glu Leu Cys Lys Asn Pro Thr Cys Val Gly Cys Tyr
(SEQ ID NO: 6453) Cys Glu Leu Cys Lys Asn Pro Thr Cys Val Ala Cys Tyr
(SEQ ID NO: 6454) Cys Glu Leu Cys Lys Asn Pro Thr Cys Gly Gly Cys Tyr
(SEQ ID NO: 6455) Cys Glu Leu Cys Lys Asn Pro Thr Cys Gly Ala Cys Tyr
(SEQ ID NO: 6456) Cys Glu Leu Cys Lys Asn Gly Ala Cys Thr Gly Cys Tyr
(SEQ ID NO: 6457) Cys Glu Leu Cys Lys Asn Gly Ala Cys Thr Ala Cys Tyr
(SEQ ID NO: 6458) Cys Glu Leu Cys Lys Asn Gly Ala Cys Val Gly Cys Tyr
(SEQ ID NO: 6459) Cys Glu Leu Cys Lys Asn Gly Ala Cys Val Ala Cys Tyr
(SEQ ID NO: 6460) Cys Glu Leu Cys Lys Asn Gly Ala Cys Gly Gly Cys Tyr
(SEQ ID NO: 6461) Cys Glu Leu Cys Lys Asn Gly Ala Cys Gly Ala Cys Tyr
(SEQ ID NO: 6462) Cys Glu Leu Cys Lys Asn Gly Thr Cys Thr Gly Cys Tyr
(SEQ ID NO: 6463) Cys Glu Leu Cys Lys Asn Gly Thr Cys Thr Ala Cys Tyr
(SEQ ID NO: 6464) Cys Glu Leu Cys Lys Asn Gly Thr Cys Val Gly Cys Tyr
(SEQ ID NO: 6465) Cys Glu Leu Cys Lys Asn Gly Thr Cys Val Ala Cys Tyr
(SEQ ID NO: 6466) Cys Glu Leu Cys Lys Asn Gly Thr Cys Gly Gly Cys Tyr
(SEQ ID NO: 6467) Cys Glu Leu Cys Lys Asn Gly Thr Cys Gly Ala Cys Tyr
(SEQ ID NO: 6468) Cys Glu Leu Cys Met Asn Pro Ala Cys Thr Gly Cys Tyr
(SEQ ID NO: 6469) Cys Glu Leu Cys Met Asn Pro Ala Cys Thr Ala Cys Tyr
(SEQ ID NO: 6470) Cys Glu Leu Cys Met Asn Pro Ala Cys Val Gly Cys Tyr
(SEQ ID NO: 6471) Cys Glu Leu Cys Met Asn Pro Ala Cys Val Ala Cys Tyr
(SEQ ID NO: 6472) Cys Glu Leu Cys Met Asn Pro Ala Cys Gly Gly Cys Tyr
(SEQ ID NO: 6473) Cys Glu Leu Cys Met Asn Pro Ala Cys Gly Ala Cys Tyr
(SEQ ID NO: 6474) Cys Glu Leu Cys Met Asn Pro Thr Cys Thr Gly Cys Tyr
(SEQ ID NO: 6475) Cys Glu Leu Cys Met Asn Pro Thr Cys Thr Ala Cys Tyr
(SEQ ID NO: 6476) Cys Glu Leu Cys Met Asn Pro Thr Cys Val Gly Cys Tyr
(SEQ ID NO: 6477) Cys Glu Leu Cys Met Asn Pro Thr Cys Val Ala Cys Tyr
(SEQ ID NO: 6478) Cys Glu Leu Cys Met Asn Pro Thr Cys Gly Gly Cys Tyr
(SEQ ID NO: 6479) Cys Glu Leu Cys Met Asn Pro Thr Cys Gly Ala Cys Tyr
(SEQ ID NO: 6480) Cys Glu Leu Cys Met Asn Gly Ala Cys Thr Gly Cys Tyr
(SEQ ID NO: 6481) Cys Glu Leu Cys Met Asn Gly Ala Cys Thr Ala Cys Tyr
(SEQ ID NO: 6482) Cys Glu Leu Cys Met Asn Gly Ala Cys Val Gly Cys Tyr
(SEQ ID NO: 6483) Cys Glu Leu Cys Met Asn Gly Ala Cys Val Ala Cys Tyr

FIG. 3

(SEQ ID NO: 6484) Cys Glu Leu Cys Met Asn Gly Ala Cys Gly Gly Cys Tyr
(SEQ ID NO: 6485) Cys Glu Leu Cys Met Asn Gly Ala Cys Gly Ala Cys Tyr
(SEQ ID NO: 6486) Cys Glu Leu Cys Met Asn Gly Thr Cys Thr Gly Cys Tyr
(SEQ ID NO: 6487) Cys Glu Leu Cys Met Asn Gly Thr Cys Thr Ala Cys Tyr
(SEQ ID NO: 6488) Cys Glu Leu Cys Met Asn Gly Thr Cys Val Gly Cys Tyr
(SEQ ID NO: 6489) Cys Glu Leu Cys Met Asn Gly Thr Cys Val Ala Cys Tyr
(SEQ ID NO: 6490) Cys Glu Leu Cys Met Asn Gly Thr Cys Gly Gly Cys Tyr
(SEQ ID NO: 6491) Cys Glu Leu Cys Met Asn Gly Thr Cys Gly Ala Cys Tyr
(SEQ ID NO: 6492) Cys Glu Leu Cys Phe Asn Pro Ala Cys Thr Gly Cys Tyr
(SEQ ID NO: 6493) Cys Glu Leu Cys Phe Asn Pro Ala Cys Thr Ala Cys Tyr
(SEQ ID NO: 6494) Cys Glu Leu Cys Phe Asn Pro Ala Cys Val Gly Cys Tyr
(SEQ ID NO: 6495) Cys Glu Leu Cys Phe Asn Pro Ala Cys Val Ala Cys Tyr
(SEQ ID NO: 6496) Cys Glu Leu Cys Phe Asn Pro Ala Cys Gly Gly Cys Tyr
(SEQ ID NO: 6497) Cys Glu Leu Cys Phe Asn Pro Ala Cys Gly Ala Cys Tyr
(SEQ ID NO: 6498) Cys Glu Leu Cys Phe Asn Pro Thr Cys Thr Gly Cys Tyr
(SEQ ID NO: 6499) Cys Glu Leu Cys Phe Asn Pro Thr Cys Thr Ala Cys Tyr
(SEQ ID NO: 6500) Cys Glu Leu Cys Phe Asn Pro Thr Cys Val Gly Cys Tyr
(SEQ ID NO: 6501) Cys Glu Leu Cys Phe Asn Pro Thr Cys Val Ala Cys Tyr
(SEQ ID NO: 6502) Cys Glu Leu Cys Phe Asn Pro Thr Cys Gly Gly Cys Tyr
(SEQ ID NO: 6503) Cys Glu Leu Cys Phe Asn Pro Thr Cys Gly Ala Cys Tyr
(SEQ ID NO: 6504) Cys Glu Leu Cys Phe Asn Gly Ala Cys Thr Gly Cys Tyr
(SEQ ID NO: 6505) Cys Glu Leu Cys Phe Asn Gly Ala Cys Thr Ala Cys Tyr
(SEQ ID NO: 6506) Cys Glu Leu Cys Phe Asn Gly Ala Cys Val Gly Cys Tyr
(SEQ ID NO: 6507) Cys Glu Leu Cys Phe Asn Gly Ala Cys Val Ala Cys Tyr
(SEQ ID NO: 6508) Cys Glu Leu Cys Phe Asn Gly Ala Cys Gly Gly Cys Tyr
(SEQ ID NO: 6509) Cys Glu Leu Cys Phe Asn Gly Ala Cys Gly Ala Cys Tyr
(SEQ ID NO: 6510) Cys Glu Leu Cys Phe Asn Gly Thr Cys Thr Gly Cys Tyr
(SEQ ID NO: 6511) Cys Glu Leu Cys Phe Asn Gly Thr Cys Thr Ala Cys Tyr
(SEQ ID NO: 6512) Cys Glu Leu Cys Phe Asn Gly Thr Cys Val Gly Cys Tyr
(SEQ ID NO: 6513) Cys Glu Leu Cys Phe Asn Gly Thr Cys Val Ala Cys Tyr
(SEQ ID NO: 6514) Cys Glu Leu Cys Phe Asn Gly Thr Cys Gly Gly Cys Tyr
(SEQ ID NO: 6515) Cys Glu Leu Cys Phe Asn Gly Thr Cys Gly Ala Cys Tyr
(SEQ ID NO: 6516) Cys Glu Leu Cys Pro Asn Pro Ala Cys Thr Gly Cys Tyr
(SEQ ID NO: 6517) Cys Glu Leu Cys Pro Asn Pro Ala Cys Thr Ala Cys Tyr
(SEQ ID NO: 6518) Cys Glu Leu Cys Pro Asn Pro Ala Cys Val Gly Cys Tyr
(SEQ ID NO: 6519) Cys Glu Leu Cys Pro Asn Pro Ala Cys Val Ala Cys Tyr
(SEQ ID NO: 6520) Cys Glu Leu Cys Pro Asn Pro Ala Cys Gly Gly Cys Tyr
(SEQ ID NO: 6521) Cys Glu Leu Cys Pro Asn Pro Ala Cys Gly Ala Cys Tyr
(SEQ ID NO: 6522) Cys Glu Leu Cys Pro Asn Pro Thr Cys Thr Gly Cys Tyr
(SEQ ID NO: 6523) Cys Glu Leu Cys Pro Asn Pro Thr Cys Thr Ala Cys Tyr
(SEQ ID NO: 6524) Cys Glu Leu Cys Pro Asn Pro Thr Cys Val Gly Cys Tyr
(SEQ ID NO: 6525) Cys Glu Leu Cys Pro Asn Pro Thr Cys Val Ala Cys Tyr
(SEQ ID NO: 6526) Cys Glu Leu Cys Pro Asn Pro Thr Cys Gly Gly Cys Tyr

FIG. 3

(SEQ ID NO: 6527) Cys Glu Leu Cys Pro Asn Pro Thr Cys Gly Ala Cys Tyr
(SEQ ID NO: 6528) Cys Glu Leu Cys Pro Asn Gly Ala Cys Thr Gly Cys Tyr
(SEQ ID NO: 6529) Cys Glu Leu Cys Pro Asn Gly Ala Cys Thr Ala Cys Tyr
(SEQ ID NO: 6530) Cys Glu Leu Cys Pro Asn Gly Ala Cys Val Gly Cys Tyr
(SEQ ID NO: 6531) Cys Glu Leu Cys Pro Asn Gly Ala Cys Val Ala Cys Tyr
(SEQ ID NO: 6532) Cys Glu Leu Cys Pro Asn Gly Ala Cys Gly Gly Cys Tyr
(SEQ ID NO: 6533) Cys Glu Leu Cys Pro Asn Gly Ala Cys Gly Ala Cys Tyr
(SEQ ID NO: 6534) Cys Glu Leu Cys Pro Asn Gly Thr Cys Thr Gly Cys Tyr
(SEQ ID NO: 6535) Cys Glu Leu Cys Pro Asn Gly Thr Cys Thr Ala Cys Tyr
(SEQ ID NO: 6536) Cys Glu Leu Cys Pro Asn Gly Thr Cys Val Gly Cys Tyr
(SEQ ID NO: 6537) Cys Glu Leu Cys Pro Asn Gly Thr Cys Val Ala Cys Tyr
(SEQ ID NO: 6538) Cys Glu Leu Cys Pro Asn Gly Thr Cys Gly Gly Cys Tyr
(SEQ ID NO: 6539) Cys Glu Leu Cys Pro Asn Gly Thr Cys Gly Ala Cys Tyr
(SEQ ID NO: 6540) Cys Glu Leu Cys Ser Asn Pro Ala Cys Thr Gly Cys Tyr
(SEQ ID NO: 6541) Cys Glu Leu Cys Ser Asn Pro Ala Cys Thr Ala Cys Tyr
(SEQ ID NO: 6542) Cys Glu Leu Cys Ser Asn Pro Ala Cys Val Gly Cys Tyr
(SEQ ID NO: 6543) Cys Glu Leu Cys Ser Asn Pro Ala Cys Val Ala Cys Tyr
(SEQ ID NO: 6544) Cys Glu Leu Cys Ser Asn Pro Ala Cys Gly Gly Cys Tyr
(SEQ ID NO: 6545) Cys Glu Leu Cys Ser Asn Pro Ala Cys Gly Ala Cys Tyr
(SEQ ID NO: 6546) Cys Glu Leu Cys Ser Asn Pro Thr Cys Thr Gly Cys Tyr
(SEQ ID NO: 6547) Cys Glu Leu Cys Ser Asn Pro Thr Cys Thr Ala Cys Tyr
(SEQ ID NO: 6548) Cys Glu Leu Cys Ser Asn Pro Thr Cys Val Gly Cys Tyr
(SEQ ID NO: 6549) Cys Glu Leu Cys Ser Asn Pro Thr Cys Val Ala Cys Tyr
(SEQ ID NO: 6550) Cys Glu Leu Cys Ser Asn Pro Thr Cys Gly Gly Cys Tyr
(SEQ ID NO: 6551) Cys Glu Leu Cys Ser Asn Pro Thr Cys Gly Ala Cys Tyr
(SEQ ID NO: 6552) Cys Glu Leu Cys Ser Asn Gly Ala Cys Thr Gly Cys Tyr
(SEQ ID NO: 6553) Cys Glu Leu Cys Ser Asn Gly Ala Cys Thr Ala Cys Tyr
(SEQ ID NO: 6554) Cys Glu Leu Cys Ser Asn Gly Ala Cys Val Gly Cys Tyr
(SEQ ID NO: 6555) Cys Glu Leu Cys Ser Asn Gly Ala Cys Val Ala Cys Tyr
(SEQ ID NO: 6556) Cys Glu Leu Cys Ser Asn Gly Ala Cys Gly Gly Cys Tyr
(SEQ ID NO: 6557) Cys Glu Leu Cys Ser Asn Gly Ala Cys Gly Ala Cys Tyr
(SEQ ID NO: 6558) Cys Glu Leu Cys Ser Asn Gly Thr Cys Thr Gly Cys Tyr
(SEQ ID NO: 6559) Cys Glu Leu Cys Ser Asn Gly Thr Cys Thr Ala Cys Tyr
(SEQ ID NO: 6560) Cys Glu Leu Cys Ser Asn Gly Thr Cys Val Gly Cys Tyr
(SEQ ID NO: 6561) Cys Glu Leu Cys Ser Asn Gly Thr Cys Val Ala Cys Tyr
(SEQ ID NO: 6562) Cys Glu Leu Cys Ser Asn Gly Thr Cys Gly Gly Cys Tyr
(SEQ ID NO: 6563) Cys Glu Leu Cys Ser Asn Gly Thr Cys Gly Ala Cys Tyr
(SEQ ID NO: 6564) Cys Glu Leu Cys Thr Asn Pro Ala Cys Thr Gly Cys Tyr
(SEQ ID NO: 6565) Cys Glu Leu Cys Thr Asn Pro Ala Cys Thr Ala Cys Tyr
(SEQ ID NO: 6566) Cys Glu Leu Cys Thr Asn Pro Ala Cys Val Gly Cys Tyr
(SEQ ID NO: 6567) Cys Glu Leu Cys Thr Asn Pro Ala Cys Val Ala Cys Tyr
(SEQ ID NO: 6568) Cys Glu Leu Cys Thr Asn Pro Ala Cys Gly Gly Cys Tyr
(SEQ ID NO: 6569) Cys Glu Leu Cys Thr Asn Pro Ala Cys Gly Ala Cys Tyr

FIG. 3

(SEQ ID NO: 6570) Cys Glu Leu Cys Thr Asn Pro Thr Cys Thr Gly Cys Tyr
(SEQ ID NO: 6571) Cys Glu Leu Cys Thr Asn Pro Thr Cys Thr Ala Cys Tyr
(SEQ ID NO: 6572) Cys Glu Leu Cys Thr Asn Pro Thr Cys Val Gly Cys Tyr
(SEQ ID NO: 6573) Cys Glu Leu Cys Thr Asn Pro Thr Cys Val Ala Cys Tyr
(SEQ ID NO: 6574) Cys Glu Leu Cys Thr Asn Pro Thr Cys Gly Gly Cys Tyr
(SEQ ID NO: 6575) Cys Glu Leu Cys Thr Asn Pro Thr Cys Gly Ala Cys Tyr
(SEQ ID NO: 6576) Cys Glu Leu Cys Thr Asn Gly Ala Cys Thr Gly Cys Tyr
(SEQ ID NO: 6577) Cys Glu Leu Cys Thr Asn Gly Ala Cys Thr Ala Cys Tyr
(SEQ ID NO: 6578) Cys Glu Leu Cys Thr Asn Gly Ala Cys Val Gly Cys Tyr
(SEQ ID NO: 6579) Cys Glu Leu Cys Thr Asn Gly Ala Cys Val Ala Cys Tyr
(SEQ ID NO: 6580) Cys Glu Leu Cys Thr Asn Gly Ala Cys Gly Gly Cys Tyr
(SEQ ID NO: 6581) Cys Glu Leu Cys Thr Asn Gly Ala Cys Gly Ala Cys Tyr
(SEQ ID NO: 6582) Cys Glu Leu Cys Thr Asn Gly Thr Cys Thr Gly Cys Tyr
(SEQ ID NO: 6583) Cys Glu Leu Cys Thr Asn Gly Thr Cys Thr Ala Cys Tyr
(SEQ ID NO: 6584) Cys Glu Leu Cys Thr Asn Gly Thr Cys Val Gly Cys Tyr
(SEQ ID NO: 6585) Cys Glu Leu Cys Thr Asn Gly Thr Cys Val Ala Cys Tyr
(SEQ ID NO: 6586) Cys Glu Leu Cys Thr Asn Gly Thr Cys Gly Gly Cys Tyr
(SEQ ID NO: 6587) Cys Glu Leu Cys Thr Asn Gly Thr Cys Gly Ala Cys Tyr
(SEQ ID NO: 6588) Cys Glu Leu Cys Trp Asn Pro Ala Cys Thr Gly Cys Tyr
(SEQ ID NO: 6589) Cys Glu Leu Cys Trp Asn Pro Ala Cys Thr Ala Cys Tyr
(SEQ ID NO: 6590) Cys Glu Leu Cys Trp Asn Pro Ala Cys Val Gly Cys Tyr
(SEQ ID NO: 6591) Cys Glu Leu Cys Trp Asn Pro Ala Cys Val Ala Cys Tyr
(SEQ ID NO: 6592) Cys Glu Leu Cys Trp Asn Pro Ala Cys Gly Gly Cys Tyr
(SEQ ID NO: 6593) Cys Glu Leu Cys Trp Asn Pro Ala Cys Gly Ala Cys Tyr
(SEQ ID NO: 6594) Cys Glu Leu Cys Trp Asn Pro Thr Cys Thr Gly Cys Tyr
(SEQ ID NO: 6595) Cys Glu Leu Cys Trp Asn Pro Thr Cys Thr Ala Cys Tyr
(SEQ ID NO: 6596) Cys Glu Leu Cys Trp Asn Pro Thr Cys Val Gly Cys Tyr
(SEQ ID NO: 6597) Cys Glu Leu Cys Trp Asn Pro Thr Cys Val Ala Cys Tyr
(SEQ ID NO: 6598) Cys Glu Leu Cys Trp Asn Pro Thr Cys Gly Gly Cys Tyr
(SEQ ID NO: 6599) Cys Glu Leu Cys Trp Asn Pro Thr Cys Gly Ala Cys Tyr
(SEQ ID NO: 6600) Cys Glu Leu Cys Trp Asn Gly Ala Cys Thr Gly Cys Tyr
(SEQ ID NO: 6601) Cys Glu Leu Cys Trp Asn Gly Ala Cys Thr Ala Cys Tyr
(SEQ ID NO: 6602) Cys Glu Leu Cys Trp Asn Gly Ala Cys Val Gly Cys Tyr
(SEQ ID NO: 6603) Cys Glu Leu Cys Trp Asn Gly Ala Cys Val Ala Cys Tyr
(SEQ ID NO: 6604) Cys Glu Leu Cys Trp Asn Gly Ala Cys Gly Gly Cys Tyr
(SEQ ID NO: 6605) Cys Glu Leu Cys Trp Asn Gly Ala Cys Gly Ala Cys Tyr
(SEQ ID NO: 6606) Cys Glu Leu Cys Trp Asn Gly Thr Cys Thr Gly Cys Tyr
(SEQ ID NO: 6607) Cys Glu Leu Cys Trp Asn Gly Thr Cys Thr Ala Cys Tyr
(SEQ ID NO: 6608) Cys Glu Leu Cys Trp Asn Gly Thr Cys Val Gly Cys Tyr
(SEQ ID NO: 6609) Cys Glu Leu Cys Trp Asn Gly Thr Cys Val Ala Cys Tyr
(SEQ ID NO: 6610) Cys Glu Leu Cys Trp Asn Gly Thr Cys Gly Gly Cys Tyr
(SEQ ID NO: 6611) Cys Glu Leu Cys Trp Asn Gly Thr Cys Gly Ala Cys Tyr
(SEQ ID NO: 6612) Cys Glu Leu Cys Tyr Asn Pro Ala Cys Thr Gly Cys Tyr

FIG. 3

(SEQ ID NO: 6613)  Cys Glu Leu Cys Tyr Asn Pro Ala Cys Thr Ala Cys Tyr
(SEQ ID NO: 6614)  Cys Glu Leu Cys Tyr Asn Pro Ala Cys Val Gly Cys Tyr
(SEQ ID NO: 6615)  Cys Glu Leu Cys Tyr Asn Pro Ala Cys Val Ala Cys Tyr
(SEQ ID NO: 6616)  Cys Glu Leu Cys Tyr Asn Pro Ala Cys Gly Gly Cys Tyr
(SEQ ID NO: 6617)  Cys Glu Leu Cys Tyr Asn Pro Ala Cys Gly Ala Cys Tyr
(SEQ ID NO: 6618)  Cys Glu Leu Cys Tyr Asn Pro Thr Cys Thr Gly Cys Tyr
(SEQ ID NO: 6619)  Cys Glu Leu Cys Tyr Asn Pro Thr Cys Thr Ala Cys Tyr
(SEQ ID NO: 6620)  Cys Glu Leu Cys Tyr Asn Pro Thr Cys Val Gly Cys Tyr
(SEQ ID NO: 6621)  Cys Glu Leu Cys Tyr Asn Pro Thr Cys Val Ala Cys Tyr
(SEQ ID NO: 6622)  Cys Glu Leu Cys Tyr Asn Pro Thr Cys Gly Gly Cys Tyr
(SEQ ID NO: 6623)  Cys Glu Leu Cys Tyr Asn Pro Thr Cys Gly Ala Cys Tyr
(SEQ ID NO: 6624)  Cys Glu Leu Cys Tyr Asn Gly Ala Cys Thr Gly Cys Tyr
(SEQ ID NO: 6625)  Cys Glu Leu Cys Tyr Asn Gly Ala Cys Thr Ala Cys Tyr
(SEQ ID NO: 6626)  Cys Glu Leu Cys Tyr Asn Gly Ala Cys Val Gly Cys Tyr
(SEQ ID NO: 6627)  Cys Glu Leu Cys Tyr Asn Gly Ala Cys Val Ala Cys Tyr
(SEQ ID NO: 6628)  Cys Glu Leu Cys Tyr Asn Gly Ala Cys Gly Gly Cys Tyr
(SEQ ID NO: 6629)  Cys Glu Leu Cys Tyr Asn Gly Ala Cys Gly Ala Cys Tyr
(SEQ ID NO: 6630)  Cys Glu Leu Cys Tyr Asn Gly Thr Cys Thr Gly Cys Tyr
(SEQ ID NO: 6631)  Cys Glu Leu Cys Tyr Asn Gly Thr Cys Thr Ala Cys Tyr
(SEQ ID NO: 6632)  Cys Glu Leu Cys Tyr Asn Gly Thr Cys Val Gly Cys Tyr
(SEQ ID NO: 6633)  Cys Glu Leu Cys Tyr Asn Gly Thr Cys Val Ala Cys Tyr
(SEQ ID NO: 6634)  Cys Glu Leu Cys Tyr Asn Gly Thr Cys Gly Gly Cys Tyr
(SEQ ID NO: 6635)  Cys Glu Leu Cys Tyr Asn Gly Thr Cys Gly Ala Cys Tyr
(SEQ ID NO: 6636)  Cys Glu Leu Cys Val Asn Pro Ala Cys Thr Gly Cys Tyr
(SEQ ID NO: 6637)  Cys Glu Leu Cys Val Asn Pro Ala Cys Thr Ala Cys Tyr
(SEQ ID NO: 6638)  Cys Glu Leu Cys Val Asn Pro Ala Cys Val Gly Cys Tyr
(SEQ ID NO: 6639)  Cys Glu Leu Cys Val Asn Pro Ala Cys Val Ala Cys Tyr
(SEQ ID NO: 6640)  Cys Glu Leu Cys Val Asn Pro Ala Cys Gly Gly Cys Tyr
(SEQ ID NO: 6641)  Cys Glu Leu Cys Val Asn Pro Ala Cys Gly Ala Cys Tyr
(SEQ ID NO: 6642)  Cys Glu Leu Cys Val Asn Pro Thr Cys Thr Gly Cys Tyr
(SEQ ID NO: 6643)  Cys Glu Leu Cys Val Asn Pro Thr Cys Thr Ala Cys Tyr
(SEQ ID NO: 6644)  Cys Glu Leu Cys Val Asn Pro Thr Cys Val Gly Cys Tyr
(SEQ ID NO: 6645)  Cys Glu Leu Cys Val Asn Pro Thr Cys Val Ala Cys Tyr
(SEQ ID NO: 6646)  Cys Glu Leu Cys Val Asn Pro Thr Cys Gly Gly Cys Tyr
(SEQ ID NO: 6647)  Cys Glu Leu Cys Val Asn Pro Thr Cys Gly Ala Cys Tyr
(SEQ ID NO: 6648)  Cys Glu Leu Cys Val Asn Gly Ala Cys Thr Gly Cys Tyr
(SEQ ID NO: 6649)  Cys Glu Leu Cys Val Asn Gly Ala Cys Thr Ala Cys Tyr
(SEQ ID NO: 6650)  Cys Glu Leu Cys Val Asn Gly Ala Cys Val Gly Cys Tyr
(SEQ ID NO: 6651)  Cys Glu Leu Cys Val Asn Gly Ala Cys Val Ala Cys Tyr
(SEQ ID NO: 6652)  Cys Glu Leu Cys Val Asn Gly Ala Cys Gly Gly Cys Tyr
(SEQ ID NO: 6653)  Cys Glu Leu Cys Val Asn Gly Ala Cys Gly Ala Cys Tyr
(SEQ ID NO: 6654)  Cys Glu Leu Cys Val Asn Gly Thr Cys Thr Gly Cys Tyr
(SEQ ID NO: 6655)  Cys Glu Leu Cys Val Asn Gly Thr Cys Thr Ala Cys Tyr

FIG. 3

(SEQ ID NO: 6656) Cys Glu Leu Cys Val Asn Gly Thr Cys Val Gly Cys Tyr
(SEQ ID NO: 6657) Cys Glu Leu Cys Val Asn Gly Thr Cys Val Ala Cys Tyr
(SEQ ID NO: 6658) Cys Glu Leu Cys Val Asn Gly Thr Cys Gly Gly Cys Tyr
(SEQ ID NO: 6659) Cys Glu Leu Cys Val Asn Gly Thr Cys Gly Ala Cys Tyr
(SEQ ID NO: 6660) Cys Glu Leu Cys --- Asn Pro Ala Cys Thr Gly Cys Tyr
(SEQ ID NO: 6661) Cys Glu Leu Cys --- Asn Pro Ala Cys Thr Ala Cys Tyr
(SEQ ID NO: 6662) Cys Glu Leu Cys --- Asn Pro Ala Cys Val Gly Cys Tyr
(SEQ ID NO: 6663) Cys Glu Leu Cys --- Asn Pro Ala Cys Val Ala Cys Tyr
(SEQ ID NO: 6664) Cys Glu Leu Cys --- Asn Pro Ala Cys Gly Gly Cys Tyr
(SEQ ID NO: 6665) Cys Glu Leu Cys --- Asn Pro Ala Cys Gly Ala Cys Tyr
(SEQ ID NO: 6666) Cys Glu Leu Cys --- Asn Pro Thr Cys Thr Gly Cys Tyr
(SEQ ID NO: 6667) Cys Glu Leu Cys --- Asn Pro Thr Cys Thr Ala Cys Tyr
(SEQ ID NO: 6668) Cys Glu Leu Cys --- Asn Pro Thr Cys Val Gly Cys Tyr
(SEQ ID NO: 6669) Cys Glu Leu Cys --- Asn Pro Thr Cys Val Ala Cys Tyr
(SEQ ID NO: 6670) Cys Glu Leu Cys --- Asn Pro Thr Cys Gly Gly Cys Tyr
(SEQ ID NO: 6671) Cys Glu Leu Cys --- Asn Pro Thr Cys Gly Ala Cys Tyr
(SEQ ID NO: 6672) Cys Glu Leu Cys --- Asn Gly Ala Cys Thr Gly Cys Tyr
(SEQ ID NO: 6673) Cys Glu Leu Cys --- Asn Gly Ala Cys Thr Ala Cys Tyr
(SEQ ID NO: 6674) Cys Glu Leu Cys --- Asn Gly Ala Cys Val Gly Cys Tyr
(SEQ ID NO: 6675) Cys Glu Leu Cys --- Asn Gly Ala Cys Val Ala Cys Tyr
(SEQ ID NO: 6676) Cys Glu Leu Cys --- Asn Gly Ala Cys Gly Gly Cys Tyr
(SEQ ID NO: 6677) Cys Glu Leu Cys --- Asn Gly Ala Cys Gly Ala Cys Tyr
(SEQ ID NO: 6678) Cys Glu Leu Cys --- Asn Gly Thr Cys Thr Gly Cys Tyr
(SEQ ID NO: 6679) Cys Glu Leu Cys --- Asn Gly Thr Cys Thr Ala Cys Tyr
(SEQ ID NO: 6680) Cys Glu Leu Cys --- Asn Gly Thr Cys Val Gly Cys Tyr
(SEQ ID NO: 6681) Cys Glu Leu Cys --- Asn Gly Thr Cys Val Ala Cys Tyr
(SEQ ID NO: 6682) Cys Glu Leu Cys --- Asn Gly Thr Cys Gly Gly Cys Tyr
(SEQ ID NO: 6683) Cys Glu Leu Cys --- Asn Gly Thr Cys Gly Ala Cys Tyr
(SEQ ID NO: 6684) Cys Glu Tyr Cys Ala Asn Pro Ala Cys Thr Gly Cys
(SEQ ID NO: 6685) Cys Glu Tyr Cys Ala Asn Pro Ala Cys Thr Ala Cys
(SEQ ID NO: 6686) Cys Glu Tyr Cys Ala Asn Pro Ala Cys Val Gly Cys
(SEQ ID NO: 6687) Cys Glu Tyr Cys Ala Asn Pro Ala Cys Val Ala Cys
(SEQ ID NO: 6688) Cys Glu Tyr Cys Ala Asn Pro Ala Cys Gly Gly Cys
(SEQ ID NO: 6689) Cys Glu Tyr Cys Ala Asn Pro Ala Cys Gly Ala Cys
(SEQ ID NO: 6690) Cys Glu Tyr Cys Ala Asn Pro Thr Cys Thr Gly Cys
(SEQ ID NO: 6691) Cys Glu Tyr Cys Ala Asn Pro Thr Cys Thr Ala Cys
(SEQ ID NO: 6692) Cys Glu Tyr Cys Ala Asn Pro Thr Cys Val Gly Cys
(SEQ ID NO: 6693) Cys Glu Tyr Cys Ala Asn Pro Thr Cys Val Ala Cys
(SEQ ID NO: 6694) Cys Glu Tyr Cys Ala Asn Pro Thr Cys Gly Gly Cys
(SEQ ID NO: 6695) Cys Glu Tyr Cys Ala Asn Pro Thr Cys Gly Ala Cys
(SEQ ID NO: 6696) Cys Glu Tyr Cys Ala Asn Gly Ala Cys Thr Gly Cys
(SEQ ID NO: 6697) Cys Glu Tyr Cys Ala Asn Gly Ala Cys Thr Ala Cys
(SEQ ID NO: 6698) Cys Glu Tyr Cys Ala Asn Gly Ala Cys Val Gly Cys

FIG. 3

| | |
|---|---|
| (SEQ ID NO: 6699) | Cys Glu Tyr Cys Ala Asn Gly Ala Cys Val Ala Cys |
| (SEQ ID NO: 6700) | Cys Glu Tyr Cys Ala Asn Gly Ala Cys Gly Gly Cys |
| (SEQ ID NO: 6701) | Cys Glu Tyr Cys Ala Asn Gly Ala Cys Gly Ala Cys |
| (SEQ ID NO: 6702) | Cys Glu Tyr Cys Ala Asn Gly Thr Cys Thr Gly Cys |
| (SEQ ID NO: 6703) | Cys Glu Tyr Cys Ala Asn Gly Thr Cys Thr Ala Cys |
| (SEQ ID NO: 6704) | Cys Glu Tyr Cys Ala Asn Gly Thr Cys Val Gly Cys |
| (SEQ ID NO: 6705) | Cys Glu Tyr Cys Ala Asn Gly Thr Cys Val Ala Cys |
| (SEQ ID NO: 6706) | Cys Glu Tyr Cys Ala Asn Gly Thr Cys Gly Gly Cys |
| (SEQ ID NO: 6707) | Cys Glu Tyr Cys Ala Asn Gly Thr Cys Gly Ala Cys |
| (SEQ ID NO: 6708) | Cys Glu Tyr Cys Arg Asn Pro Ala Cys Thr Gly Cys |
| (SEQ ID NO: 6709) | Cys Glu Tyr Cys Arg Asn Pro Ala Cys Thr Ala Cys |
| (SEQ ID NO: 6710) | Cys Glu Tyr Cys Arg Asn Pro Ala Cys Val Gly Cys |
| (SEQ ID NO: 6711) | Cys Glu Tyr Cys Arg Asn Pro Ala Cys Val Ala Cys |
| (SEQ ID NO: 6712) | Cys Glu Tyr Cys Arg Asn Pro Ala Cys Gly Gly Cys |
| (SEQ ID NO: 6713) | Cys Glu Tyr Cys Arg Asn Pro Ala Cys Gly Ala Cys |
| (SEQ ID NO: 6714) | Cys Glu Tyr Cys Arg Asn Pro Thr Cys Thr Gly Cys |
| (SEQ ID NO: 6715) | Cys Glu Tyr Cys Arg Asn Pro Thr Cys Thr Ala Cys |
| (SEQ ID NO: 6716) | Cys Glu Tyr Cys Arg Asn Pro Thr Cys Val Gly Cys |
| (SEQ ID NO: 6717) | Cys Glu Tyr Cys Arg Asn Pro Thr Cys Val Ala Cys |
| (SEQ ID NO: 6718) | Cys Glu Tyr Cys Arg Asn Pro Thr Cys Gly Gly Cys |
| (SEQ ID NO: 6719) | Cys Glu Tyr Cys Arg Asn Pro Thr Cys Gly Ala Cys |
| (SEQ ID NO: 6720) | Cys Glu Tyr Cys Arg Asn Gly Ala Cys Thr Gly Cys |
| (SEQ ID NO: 6721) | Cys Glu Tyr Cys Arg Asn Gly Ala Cys Thr Ala Cys |
| (SEQ ID NO: 6722) | Cys Glu Tyr Cys Arg Asn Gly Ala Cys Val Gly Cys |
| (SEQ ID NO: 6723) | Cys Glu Tyr Cys Arg Asn Gly Ala Cys Val Ala Cys |
| (SEQ ID NO: 6724) | Cys Glu Tyr Cys Arg Asn Gly Ala Cys Gly Gly Cys |
| (SEQ ID NO: 6725) | Cys Glu Tyr Cys Arg Asn Gly Ala Cys Gly Ala Cys |
| (SEQ ID NO: 6726) | Cys Glu Tyr Cys Arg Asn Gly Thr Cys Thr Gly Cys |
| (SEQ ID NO: 6727) | Cys Glu Tyr Cys Arg Asn Gly Thr Cys Thr Ala Cys |
| (SEQ ID NO: 6728) | Cys Glu Tyr Cys Arg Asn Gly Thr Cys Val Gly Cys |
| (SEQ ID NO: 6729) | Cys Glu Tyr Cys Arg Asn Gly Thr Cys Val Ala Cys |
| (SEQ ID NO: 6730) | Cys Glu Tyr Cys Arg Asn Gly Thr Cys Gly Gly Cys |
| (SEQ ID NO: 6731) | Cys Glu Tyr Cys Arg Asn Gly Thr Cys Gly Ala Cys |
| (SEQ ID NO: 6732) | Cys Glu Tyr Cys Asn Asn Pro Ala Cys Thr Gly Cys |
| (SEQ ID NO: 6733) | Cys Glu Tyr Cys Asn Asn Pro Ala Cys Thr Ala Cys |
| (SEQ ID NO: 6734) | Cys Glu Tyr Cys Asn Asn Pro Ala Cys Val Gly Cys |
| (SEQ ID NO: 6735) | Cys Glu Tyr Cys Asn Asn Pro Ala Cys Val Ala Cys |
| (SEQ ID NO: 6736) | Cys Glu Tyr Cys Asn Asn Pro Ala Cys Gly Gly Cys |
| (SEQ ID NO: 6737) | Cys Glu Tyr Cys Asn Asn Pro Ala Cys Gly Ala Cys |
| (SEQ ID NO: 6738) | Cys Glu Tyr Cys Asn Asn Pro Thr Cys Thr Gly Cys |
| (SEQ ID NO: 6739) | Cys Glu Tyr Cys Asn Asn Pro Thr Cys Thr Ala Cys |
| (SEQ ID NO: 6740) | Cys Glu Tyr Cys Asn Asn Pro Thr Cys Val Gly Cys |
| (SEQ ID NO: 6741) | Cys Glu Tyr Cys Asn Asn Pro Thr Cys Val Ala Cys |

FIG. 3

| | |
|---|---|
| (SEQ ID NO: 6742) | Cys Glu Tyr Cys Asn Asn Pro Thr Cys Gly Gly Cys |
| (SEQ ID NO: 6743) | Cys Glu Tyr Cys Asn Asn Pro Thr Cys Gly Ala Cys |
| (SEQ ID NO: 6744) | Cys Glu Tyr Cys Asn Asn Gly Ala Cys Thr Gly Cys |
| (SEQ ID NO: 6745) | Cys Glu Tyr Cys Asn Asn Gly Ala Cys Thr Ala Cys |
| (SEQ ID NO: 6746) | Cys Glu Tyr Cys Asn Asn Gly Ala Cys Val Gly Cys |
| (SEQ ID NO: 6747) | Cys Glu Tyr Cys Asn Asn Gly Ala Cys Val Ala Cys |
| (SEQ ID NO: 6748) | Cys Glu Tyr Cys Asn Asn Gly Ala Cys Gly Gly Cys |
| (SEQ ID NO: 6749) | Cys Glu Tyr Cys Asn Asn Gly Ala Cys Gly Ala Cys |
| (SEQ ID NO: 6750) | Cys Glu Tyr Cys Asn Asn Gly Thr Cys Thr Gly Cys |
| (SEQ ID NO: 6751) | Cys Glu Tyr Cys Asn Asn Gly Thr Cys Thr Ala Cys |
| (SEQ ID NO: 6752) | Cys Glu Tyr Cys Asn Asn Gly Thr Cys Val Gly Cys |
| (SEQ ID NO: 6753) | Cys Glu Tyr Cys Asn Asn Gly Thr Cys Val Ala Cys |
| (SEQ ID NO: 6754) | Cys Glu Tyr Cys Asn Asn Gly Thr Cys Gly Gly Cys |
| (SEQ ID NO: 6755) | Cys Glu Tyr Cys Asn Asn Gly Thr Cys Gly Ala Cys |
| (SEQ ID NO: 6756) | Cys Glu Tyr Cys Asp Asn Pro Ala Cys Thr Gly Cys |
| (SEQ ID NO: 6757) | Cys Glu Tyr Cys Asp Asn Pro Ala Cys Thr Ala Cys |
| (SEQ ID NO: 6758) | Cys Glu Tyr Cys Asp Asn Pro Ala Cys Val Gly Cys |
| (SEQ ID NO: 6759) | Cys Glu Tyr Cys Asp Asn Pro Ala Cys Val Ala Cys |
| (SEQ ID NO: 6760) | Cys Glu Tyr Cys Asp Asn Pro Ala Cys Gly Gly Cys |
| (SEQ ID NO: 6761) | Cys Glu Tyr Cys Asp Asn Pro Ala Cys Gly Ala Cys |
| (SEQ ID NO: 6762) | Cys Glu Tyr Cys Asp Asn Pro Thr Cys Thr Gly Cys |
| (SEQ ID NO: 6763) | Cys Glu Tyr Cys Asp Asn Pro Thr Cys Thr Ala Cys |
| (SEQ ID NO: 6764) | Cys Glu Tyr Cys Asp Asn Pro Thr Cys Val Gly Cys |
| (SEQ ID NO: 6765) | Cys Glu Tyr Cys Asp Asn Pro Thr Cys Val Ala Cys |
| (SEQ ID NO: 6766) | Cys Glu Tyr Cys Asp Asn Pro Thr Cys Gly Gly Cys |
| (SEQ ID NO: 6767) | Cys Glu Tyr Cys Asp Asn Pro Thr Cys Gly Ala Cys |
| (SEQ ID NO: 6768) | Cys Glu Tyr Cys Asp Asn Gly Ala Cys Thr Gly Cys |
| (SEQ ID NO: 6769) | Cys Glu Tyr Cys Asp Asn Gly Ala Cys Thr Ala Cys |
| (SEQ ID NO: 6770) | Cys Glu Tyr Cys Asp Asn Gly Ala Cys Val Gly Cys |
| (SEQ ID NO: 6771) | Cys Glu Tyr Cys Asp Asn Gly Ala Cys Val Ala Cys |
| (SEQ ID NO: 6772) | Cys Glu Tyr Cys Asp Asn Gly Ala Cys Gly Gly Cys |
| (SEQ ID NO: 6773) | Cys Glu Tyr Cys Asp Asn Gly Ala Cys Gly Ala Cys |
| (SEQ ID NO: 6774) | Cys Glu Tyr Cys Asp Asn Gly Thr Cys Thr Gly Cys |
| (SEQ ID NO: 6775) | Cys Glu Tyr Cys Asp Asn Gly Thr Cys Thr Ala Cys |
| (SEQ ID NO: 6776) | Cys Glu Tyr Cys Asp Asn Gly Thr Cys Val Gly Cys |
| (SEQ ID NO: 6777) | Cys Glu Tyr Cys Asp Asn Gly Thr Cys Val Ala Cys |
| (SEQ ID NO: 6778) | Cys Glu Tyr Cys Asp Asn Gly Thr Cys Gly Gly Cys |
| (SEQ ID NO: 6779) | Cys Glu Tyr Cys Asp Asn Gly Thr Cys Gly Ala Cys |
| (SEQ ID NO: 6780) | Cys Glu Tyr Cys Gln Asn Pro Ala Cys Thr Gly Cys |
| (SEQ ID NO: 6781) | Cys Glu Tyr Cys Gln Asn Pro Ala Cys Thr Ala Cys |
| (SEQ ID NO: 6782) | Cys Glu Tyr Cys Gln Asn Pro Ala Cys Val Gly Cys |
| (SEQ ID NO: 6783) | Cys Glu Tyr Cys Gln Asn Pro Ala Cys Val Ala Cys |
| (SEQ ID NO: 6784) | Cys Glu Tyr Cys Gln Asn Pro Ala Cys Gly Gly Cys |

FIG. 3

| | |
|---|---|
| (SEQ ID NO: 6785) | Cys Glu Tyr Cys Gln Asn Pro Ala Cys Gly Ala Cys |
| (SEQ ID NO: 6786) | Cys Glu Tyr Cys Gln Asn Pro Thr Cys Thr Gly Cys |
| (SEQ ID NO: 6787) | Cys Glu Tyr Cys Gln Asn Pro Thr Cys Thr Ala Cys |
| (SEQ ID NO: 6788) | Cys Glu Tyr Cys Gln Asn Pro Thr Cys Val Gly Cys |
| (SEQ ID NO: 6789) | Cys Glu Tyr Cys Gln Asn Pro Thr Cys Val Ala Cys |
| (SEQ ID NO: 6790) | Cys Glu Tyr Cys Gln Asn Pro Thr Cys Gly Gly Cys |
| (SEQ ID NO: 6791) | Cys Glu Tyr Cys Gln Asn Pro Thr Cys Gly Ala Cys |
| (SEQ ID NO: 6792) | Cys Glu Tyr Cys Gln Asn Gly Ala Cys Thr Gly Cys |
| (SEQ ID NO: 6793) | Cys Glu Tyr Cys Gln Asn Gly Ala Cys Thr Ala Cys |
| (SEQ ID NO: 6794) | Cys Glu Tyr Cys Gln Asn Gly Ala Cys Val Gly Cys |
| (SEQ ID NO: 6795) | Cys Glu Tyr Cys Gln Asn Gly Ala Cys Val Ala Cys |
| (SEQ ID NO: 6796) | Cys Glu Tyr Cys Gln Asn Gly Ala Cys Gly Gly Cys |
| (SEQ ID NO: 6797) | Cys Glu Tyr Cys Gln Asn Gly Ala Cys Gly Ala Cys |
| (SEQ ID NO: 6798) | Cys Glu Tyr Cys Gln Asn Gly Thr Cys Thr Gly Cys |
| (SEQ ID NO: 6799) | Cys Glu Tyr Cys Gln Asn Gly Thr Cys Thr Ala Cys |
| (SEQ ID NO: 6800) | Cys Glu Tyr Cys Gln Asn Gly Thr Cys Val Gly Cys |
| (SEQ ID NO: 6801) | Cys Glu Tyr Cys Gln Asn Gly Thr Cys Val Ala Cys |
| (SEQ ID NO: 6802) | Cys Glu Tyr Cys Gln Asn Gly Thr Cys Gly Gly Cys |
| (SEQ ID NO: 6803) | Cys Glu Tyr Cys Gln Asn Gly Thr Cys Gly Ala Cys |
| (SEQ ID NO: 6804) | Cys Glu Tyr Cys Glu Asn Pro Ala Cys Thr Gly Cys |
| (SEQ ID NO: 6805) | Cys Glu Tyr Cys Glu Asn Pro Ala Cys Thr Ala Cys |
| (SEQ ID NO: 6806) | Cys Glu Tyr Cys Glu Asn Pro Ala Cys Val Gly Cys |
| (SEQ ID NO: 6807) | Cys Glu Tyr Cys Glu Asn Pro Ala Cys Val Ala Cys |
| (SEQ ID NO: 6808) | Cys Glu Tyr Cys Glu Asn Pro Ala Cys Gly Gly Cys |
| (SEQ ID NO: 6809) | Cys Glu Tyr Cys Glu Asn Pro Ala Cys Gly Ala Cys |
| (SEQ ID NO: 6810) | Cys Glu Tyr Cys Glu Asn Pro Thr Cys Thr Gly Cys |
| (SEQ ID NO: 6811) | Cys Glu Tyr Cys Glu Asn Pro Thr Cys Thr Ala Cys |
| (SEQ ID NO: 6812) | Cys Glu Tyr Cys Glu Asn Pro Thr Cys Val Gly Cys |
| (SEQ ID NO: 6813) | Cys Glu Tyr Cys Glu Asn Pro Thr Cys Val Ala Cys |
| (SEQ ID NO: 6814) | Cys Glu Tyr Cys Glu Asn Pro Thr Cys Gly Gly Cys |
| (SEQ ID NO: 6815) | Cys Glu Tyr Cys Glu Asn Pro Thr Cys Gly Ala Cys |
| (SEQ ID NO: 6816) | Cys Glu Tyr Cys Glu Asn Gly Ala Cys Thr Gly Cys |
| (SEQ ID NO: 6817) | Cys Glu Tyr Cys Glu Asn Gly Ala Cys Thr Ala Cys |
| (SEQ ID NO: 6818) | Cys Glu Tyr Cys Glu Asn Gly Ala Cys Val Gly Cys |
| (SEQ ID NO: 6819) | Cys Glu Tyr Cys Glu Asn Gly Ala Cys Val Ala Cys |
| (SEQ ID NO: 6820) | Cys Glu Tyr Cys Glu Asn Gly Ala Cys Gly Gly Cys |
| (SEQ ID NO: 6821) | Cys Glu Tyr Cys Glu Asn Gly Ala Cys Gly Ala Cys |
| (SEQ ID NO: 6822) | Cys Glu Tyr Cys Glu Asn Gly Thr Cys Thr Gly Cys |
| (SEQ ID NO: 6823) | Cys Glu Tyr Cys Glu Asn Gly Thr Cys Thr Ala Cys |
| (SEQ ID NO: 6824) | Cys Glu Tyr Cys Glu Asn Gly Thr Cys Val Gly Cys |
| (SEQ ID NO: 6825) | Cys Glu Tyr Cys Glu Asn Gly Thr Cys Val Ala Cys |
| (SEQ ID NO: 6826) | Cys Glu Tyr Cys Glu Asn Gly Thr Cys Gly Gly Cys |
| (SEQ ID NO: 6827) | Cys Glu Tyr Cys Glu Asn Gly Thr Cys Gly Ala Cys |

FIG. 3

| | |
|---|---|
| (SEQ ID NO: 6828) | Cys Glu Tyr Cys Gly Asn Pro Ala Cys Thr Gly Cys |
| (SEQ ID NO: 6829) | Cys Glu Tyr Cys Gly Asn Pro Ala Cys Thr Ala Cys |
| (SEQ ID NO: 6830) | Cys Glu Tyr Cys Gly Asn Pro Ala Cys Val Gly Cys |
| (SEQ ID NO: 6831) | Cys Glu Tyr Cys Gly Asn Pro Ala Cys Val Ala Cys |
| (SEQ ID NO: 6832) | Cys Glu Tyr Cys Gly Asn Pro Ala Cys Gly Gly Cys |
| (SEQ ID NO: 6833) | Cys Glu Tyr Cys Gly Asn Pro Ala Cys Gly Ala Cys |
| (SEQ ID NO: 6834) | Cys Glu Tyr Cys Gly Asn Pro Thr Cys Thr Gly Cys |
| (SEQ ID NO: 6835) | Cys Glu Tyr Cys Gly Asn Pro Thr Cys Thr Ala Cys |
| (SEQ ID NO: 6836) | Cys Glu Tyr Cys Gly Asn Pro Thr Cys Val Gly Cys |
| (SEQ ID NO: 6837) | Cys Glu Tyr Cys Gly Asn Pro Thr Cys Val Ala Cys |
| (SEQ ID NO: 6838) | Cys Glu Tyr Cys Gly Asn Pro Thr Cys Gly Gly Cys |
| (SEQ ID NO: 6839) | Cys Glu Tyr Cys Gly Asn Pro Thr Cys Gly Ala Cys |
| (SEQ ID NO: 6840) | Cys Glu Tyr Cys Gly Asn Gly Ala Cys Thr Gly Cys |
| (SEQ ID NO: 6841) | Cys Glu Tyr Cys Gly Asn Gly Ala Cys Thr Ala Cys |
| (SEQ ID NO: 6842) | Cys Glu Tyr Cys Gly Asn Gly Ala Cys Val Gly Cys |
| (SEQ ID NO: 6843) | Cys Glu Tyr Cys Gly Asn Gly Ala Cys Val Ala Cys |
| (SEQ ID NO: 6844) | Cys Glu Tyr Cys Gly Asn Gly Ala Cys Gly Gly Cys |
| (SEQ ID NO: 6845) | Cys Glu Tyr Cys Gly Asn Gly Ala Cys Gly Ala Cys |
| (SEQ ID NO: 6846) | Cys Glu Tyr Cys Gly Asn Gly Thr Cys Thr Gly Cys |
| (SEQ ID NO: 6847) | Cys Glu Tyr Cys Gly Asn Gly Thr Cys Thr Ala Cys |
| (SEQ ID NO: 6848) | Cys Glu Tyr Cys Gly Asn Gly Thr Cys Val Gly Cys |
| (SEQ ID NO: 6849) | Cys Glu Tyr Cys Gly Asn Gly Thr Cys Val Ala Cys |
| (SEQ ID NO: 6850) | Cys Glu Tyr Cys Gly Asn Gly Thr Cys Gly Gly Cys |
| (SEQ ID NO: 6851) | Cys Glu Tyr Cys Gly Asn Gly Thr Cys Gly Ala Cys |
| (SEQ ID NO: 6852) | Cys Glu Tyr Cys His Asn Pro Ala Cys Thr Gly Cys |
| (SEQ ID NO: 6853) | Cys Glu Tyr Cys His Asn Pro Ala Cys Thr Ala Cys |
| (SEQ ID NO: 6854) | Cys Glu Tyr Cys His Asn Pro Ala Cys Val Gly Cys |
| (SEQ ID NO: 6855) | Cys Glu Tyr Cys His Asn Pro Ala Cys Val Ala Cys |
| (SEQ ID NO: 6856) | Cys Glu Tyr Cys His Asn Pro Ala Cys Gly Gly Cys |
| (SEQ ID NO: 6857) | Cys Glu Tyr Cys His Asn Pro Ala Cys Gly Ala Cys |
| (SEQ ID NO: 6858) | Cys Glu Tyr Cys His Asn Pro Thr Cys Thr Gly Cys |
| (SEQ ID NO: 6859) | Cys Glu Tyr Cys His Asn Pro Thr Cys Thr Ala Cys |
| (SEQ ID NO: 6860) | Cys Glu Tyr Cys His Asn Pro Thr Cys Val Gly Cys |
| (SEQ ID NO: 6861) | Cys Glu Tyr Cys His Asn Pro Thr Cys Val Ala Cys |
| (SEQ ID NO: 6862) | Cys Glu Tyr Cys His Asn Pro Thr Cys Gly Gly Cys |
| (SEQ ID NO: 6863) | Cys Glu Tyr Cys His Asn Pro Thr Cys Gly Ala Cys |
| (SEQ ID NO: 6864) | Cys Glu Tyr Cys His Asn Gly Ala Cys Thr Gly Cys |
| (SEQ ID NO: 6865) | Cys Glu Tyr Cys His Asn Gly Ala Cys Thr Ala Cys |
| (SEQ ID NO: 6866) | Cys Glu Tyr Cys His Asn Gly Ala Cys Val Gly Cys |
| (SEQ ID NO: 6867) | Cys Glu Tyr Cys His Asn Gly Ala Cys Val Ala Cys |
| (SEQ ID NO: 6868) | Cys Glu Tyr Cys His Asn Gly Ala Cys Gly Gly Cys |
| (SEQ ID NO: 6869) | Cys Glu Tyr Cys His Asn Gly Ala Cys Gly Ala Cys |
| (SEQ ID NO: 6870) | Cys Glu Tyr Cys His Asn Gly Thr Cys Thr Gly Cys |

FIG. 3

(SEQ ID NO: 6871) Cys Glu Tyr Cys His Asn Gly Thr Cys Thr Ala Cys
(SEQ ID NO: 6872) Cys Glu Tyr Cys His Asn Gly Thr Cys Val Gly Cys
(SEQ ID NO: 6873) Cys Glu Tyr Cys His Asn Gly Thr Cys Val Ala Cys
(SEQ ID NO: 6874) Cys Glu Tyr Cys His Asn Gly Thr Cys Gly Gly Cys
(SEQ ID NO: 6875) Cys Glu Tyr Cys His Asn Gly Thr Cys Gly Ala Cys
(SEQ ID NO: 6876) Cys Glu Tyr Cys Ile Asn Pro Ala Cys Thr Gly Cys
(SEQ ID NO: 6877) Cys Glu Tyr Cys Ile Asn Pro Ala Cys Thr Ala Cys
(SEQ ID NO: 6878) Cys Glu Tyr Cys Ile Asn Pro Ala Cys Val Gly Cys
(SEQ ID NO: 6879) Cys Glu Tyr Cys Ile Asn Pro Ala Cys Val Ala Cys
(SEQ ID NO: 6880) Cys Glu Tyr Cys Ile Asn Pro Ala Cys Gly Gly Cys
(SEQ ID NO: 6881) Cys Glu Tyr Cys Ile Asn Pro Ala Cys Gly Ala Cys
(SEQ ID NO: 6882) Cys Glu Tyr Cys Ile Asn Pro Thr Cys Thr Gly Cys
(SEQ ID NO: 6883) Cys Glu Tyr Cys Ile Asn Pro Thr Cys Thr Ala Cys
(SEQ ID NO: 6884) Cys Glu Tyr Cys Ile Asn Pro Thr Cys Val Gly Cys
(SEQ ID NO: 6885) Cys Glu Tyr Cys Ile Asn Pro Thr Cys Val Ala Cys
(SEQ ID NO: 6886) Cys Glu Tyr Cys Ile Asn Pro Thr Cys Gly Gly Cys
(SEQ ID NO: 6887) Cys Glu Tyr Cys Ile Asn Pro Thr Cys Gly Ala Cys
(SEQ ID NO: 6888) Cys Glu Tyr Cys Ile Asn Gly Ala Cys Thr Gly Cys
(SEQ ID NO: 6889) Cys Glu Tyr Cys Ile Asn Gly Ala Cys Thr Ala Cys
(SEQ ID NO: 6890) Cys Glu Tyr Cys Ile Asn Gly Ala Cys Val Gly Cys
(SEQ ID NO: 6891) Cys Glu Tyr Cys Ile Asn Gly Ala Cys Val Ala Cys
(SEQ ID NO: 6892) Cys Glu Tyr Cys Ile Asn Gly Ala Cys Gly Gly Cys
(SEQ ID NO: 6893) Cys Glu Tyr Cys Ile Asn Gly Ala Cys Gly Ala Cys
(SEQ ID NO: 6894) Cys Glu Tyr Cys Ile Asn Gly Thr Cys Thr Gly Cys
(SEQ ID NO: 6895) Cys Glu Tyr Cys Ile Asn Gly Thr Cys Thr Ala Cys
(SEQ ID NO: 6896) Cys Glu Tyr Cys Ile Asn Gly Thr Cys Val Gly Cys
(SEQ ID NO: 6897) Cys Glu Tyr Cys Ile Asn Gly Thr Cys Val Ala Cys
(SEQ ID NO: 6898) Cys Glu Tyr Cys Ile Asn Gly Thr Cys Gly Gly Cys
(SEQ ID NO: 6899) Cys Glu Tyr Cys Ile Asn Gly Thr Cys Gly Ala Cys
(SEQ ID NO: 6900) Cys Glu Tyr Cys Leu Asn Pro Ala Cys Thr Gly Cys
(SEQ ID NO: 6901) Cys Glu Tyr Cys Leu Asn Pro Ala Cys Thr Ala Cys
(SEQ ID NO: 6902) Cys Glu Tyr Cys Leu Asn Pro Ala Cys Val Gly Cys
(SEQ ID NO: 6903) Cys Glu Tyr Cys Leu Asn Pro Ala Cys Val Ala Cys
(SEQ ID NO: 6904) Cys Glu Tyr Cys Leu Asn Pro Ala Cys Gly Gly Cys
(SEQ ID NO: 6905) Cys Glu Tyr Cys Leu Asn Pro Ala Cys Gly Ala Cys
(SEQ ID NO: 6906) Cys Glu Tyr Cys Leu Asn Pro Thr Cys Thr Gly Cys
(SEQ ID NO: 6907) Cys Glu Tyr Cys Leu Asn Pro Thr Cys Thr Ala Cys
(SEQ ID NO: 6908) Cys Glu Tyr Cys Leu Asn Pro Thr Cys Val Gly Cys
(SEQ ID NO: 6909) Cys Glu Tyr Cys Leu Asn Pro Thr Cys Val Ala Cys
(SEQ ID NO: 6910) Cys Glu Tyr Cys Leu Asn Pro Thr Cys Gly Gly Cys
(SEQ ID NO: 6911) Cys Glu Tyr Cys Leu Asn Pro Thr Cys Gly Ala Cys
(SEQ ID NO: 6912) Cys Glu Tyr Cys Leu Asn Gly Ala Cys Thr Gly Cys
(SEQ ID NO: 6913) Cys Glu Tyr Cys Leu Asn Gly Ala Cys Thr Ala Cys

FIG. 3

| | |
|---|---|
| (SEQ ID NO: 6914) | Cys Glu Tyr Cys Leu Asn Gly Ala Cys Val Gly Cys |
| (SEQ ID NO: 6915) | Cys Glu Tyr Cys Leu Asn Gly Ala Cys Val Ala Cys |
| (SEQ ID NO: 6916) | Cys Glu Tyr Cys Leu Asn Gly Ala Cys Gly Gly Cys |
| (SEQ ID NO: 6917) | Cys Glu Tyr Cys Leu Asn Gly Ala Cys Gly Ala Cys |
| (SEQ ID NO: 6918) | Cys Glu Tyr Cys Leu Asn Gly Thr Cys Thr Gly Cys |
| (SEQ ID NO: 6919) | Cys Glu Tyr Cys Leu Asn Gly Thr Cys Thr Ala Cys |
| (SEQ ID NO: 6920) | Cys Glu Tyr Cys Leu Asn Gly Thr Cys Val Gly Cys |
| (SEQ ID NO: 6921) | Cys Glu Tyr Cys Leu Asn Gly Thr Cys Val Ala Cys |
| (SEQ ID NO: 6922) | Cys Glu Tyr Cys Leu Asn Gly Thr Cys Gly Gly Cys |
| (SEQ ID NO: 6923) | Cys Glu Tyr Cys Leu Asn Gly Thr Cys Gly Ala Cys |
| (SEQ ID NO: 6924) | Cys Glu Tyr Cys Lys Asn Pro Ala Cys Thr Gly Cys |
| (SEQ ID NO: 6925) | Cys Glu Tyr Cys Lys Asn Pro Ala Cys Thr Ala Cys |
| (SEQ ID NO: 6926) | Cys Glu Tyr Cys Lys Asn Pro Ala Cys Val Gly Cys |
| (SEQ ID NO: 6927) | Cys Glu Tyr Cys Lys Asn Pro Ala Cys Val Ala Cys |
| (SEQ ID NO: 6928) | Cys Glu Tyr Cys Lys Asn Pro Ala Cys Gly Gly Cys |
| (SEQ ID NO: 6929) | Cys Glu Tyr Cys Lys Asn Pro Ala Cys Gly Ala Cys |
| (SEQ ID NO: 6930) | Cys Glu Tyr Cys Lys Asn Pro Thr Cys Thr Gly Cys |
| (SEQ ID NO: 6931) | Cys Glu Tyr Cys Lys Asn Pro Thr Cys Thr Ala Cys |
| (SEQ ID NO: 6932) | Cys Glu Tyr Cys Lys Asn Pro Thr Cys Val Gly Cys |
| (SEQ ID NO: 6933) | Cys Glu Tyr Cys Lys Asn Pro Thr Cys Val Ala Cys |
| (SEQ ID NO: 6934) | Cys Glu Tyr Cys Lys Asn Pro Thr Cys Gly Gly Cys |
| (SEQ ID NO: 6935) | Cys Glu Tyr Cys Lys Asn Pro Thr Cys Gly Ala Cys |
| (SEQ ID NO: 6936) | Cys Glu Tyr Cys Lys Asn Gly Ala Cys Thr Gly Cys |
| (SEQ ID NO: 6937) | Cys Glu Tyr Cys Lys Asn Gly Ala Cys Thr Ala Cys |
| (SEQ ID NO: 6938) | Cys Glu Tyr Cys Lys Asn Gly Ala Cys Val Gly Cys |
| (SEQ ID NO: 6939) | Cys Glu Tyr Cys Lys Asn Gly Ala Cys Val Ala Cys |
| (SEQ ID NO: 6940) | Cys Glu Tyr Cys Lys Asn Gly Ala Cys Gly Gly Cys |
| (SEQ ID NO: 6941) | Cys Glu Tyr Cys Lys Asn Gly Ala Cys Gly Ala Cys |
| (SEQ ID NO: 6942) | Cys Glu Tyr Cys Lys Asn Gly Thr Cys Thr Gly Cys |
| (SEQ ID NO: 6943) | Cys Glu Tyr Cys Lys Asn Gly Thr Cys Thr Ala Cys |
| (SEQ ID NO: 6944) | Cys Glu Tyr Cys Lys Asn Gly Thr Cys Val Gly Cys |
| (SEQ ID NO: 6945) | Cys Glu Tyr Cys Lys Asn Gly Thr Cys Val Ala Cys |
| (SEQ ID NO: 6946) | Cys Glu Tyr Cys Lys Asn Gly Thr Cys Gly Gly Cys |
| (SEQ ID NO: 6947) | Cys Glu Tyr Cys Lys Asn Gly Thr Cys Gly Ala Cys |
| (SEQ ID NO: 6948) | Cys Glu Tyr Cys Met Asn Pro Ala Cys Thr Gly Cys |
| (SEQ ID NO: 6949) | Cys Glu Tyr Cys Met Asn Pro Ala Cys Thr Ala Cys |
| (SEQ ID NO: 6950) | Cys Glu Tyr Cys Met Asn Pro Ala Cys Val Gly Cys |
| (SEQ ID NO: 6951) | Cys Glu Tyr Cys Met Asn Pro Ala Cys Val Ala Cys |
| (SEQ ID NO: 6952) | Cys Glu Tyr Cys Met Asn Pro Ala Cys Gly Gly Cys |
| (SEQ ID NO: 6953) | Cys Glu Tyr Cys Met Asn Pro Ala Cys Gly Ala Cys |
| (SEQ ID NO: 6954) | Cys Glu Tyr Cys Met Asn Pro Thr Cys Thr Gly Cys |
| (SEQ ID NO: 6955) | Cys Glu Tyr Cys Met Asn Pro Thr Cys Thr Ala Cys |
| (SEQ ID NO: 6956) | Cys Glu Tyr Cys Met Asn Pro Thr Cys Val Gly Cys |

FIG. 3

(SEQ ID NO: 6957)  Cys Glu Tyr Cys Met Asn Pro Thr Cys Val Ala Cys
(SEQ ID NO: 6958)  Cys Glu Tyr Cys Met Asn Pro Thr Cys Gly Gly Cys
(SEQ ID NO: 6959)  Cys Glu Tyr Cys Met Asn Pro Thr Cys Gly Ala Cys
(SEQ ID NO: 6960)  Cys Glu Tyr Cys Met Asn Gly Ala Cys Thr Gly Cys
(SEQ ID NO: 6961)  Cys Glu Tyr Cys Met Asn Gly Ala Cys Thr Ala Cys
(SEQ ID NO: 6962)  Cys Glu Tyr Cys Met Asn Gly Ala Cys Val Gly Cys
(SEQ ID NO: 6963)  Cys Glu Tyr Cys Met Asn Gly Ala Cys Val Ala Cys
(SEQ ID NO: 6964)  Cys Glu Tyr Cys Met Asn Gly Ala Cys Gly Gly Cys
(SEQ ID NO: 6965)  Cys Glu Tyr Cys Met Asn Gly Ala Cys Gly Ala Cys
(SEQ ID NO: 6966)  Cys Glu Tyr Cys Met Asn Gly Thr Cys Thr Gly Cys
(SEQ ID NO: 6967)  Cys Glu Tyr Cys Met Asn Gly Thr Cys Thr Ala Cys
(SEQ ID NO: 6968)  Cys Glu Tyr Cys Met Asn Gly Thr Cys Val Gly Cys
(SEQ ID NO: 6969)  Cys Glu Tyr Cys Met Asn Gly Thr Cys Val Ala Cys
(SEQ ID NO: 6970)  Cys Glu Tyr Cys Met Asn Gly Thr Cys Gly Gly Cys
(SEQ ID NO: 6971)  Cys Glu Tyr Cys Met Asn Gly Thr Cys Gly Ala Cys
(SEQ ID NO: 6972)  Cys Glu Tyr Cys Phe Asn Pro Ala Cys Thr Gly Cys
(SEQ ID NO: 6973)  Cys Glu Tyr Cys Phe Asn Pro Ala Cys Thr Ala Cys
(SEQ ID NO: 6974)  Cys Glu Tyr Cys Phe Asn Pro Ala Cys Val Gly Cys
(SEQ ID NO: 6975)  Cys Glu Tyr Cys Phe Asn Pro Ala Cys Val Ala Cys
(SEQ ID NO: 6976)  Cys Glu Tyr Cys Phe Asn Pro Ala Cys Gly Gly Cys
(SEQ ID NO: 6977)  Cys Glu Tyr Cys Phe Asn Pro Ala Cys Gly Ala Cys
(SEQ ID NO: 6978)  Cys Glu Tyr Cys Phe Asn Pro Thr Cys Thr Gly Cys
(SEQ ID NO: 6979)  Cys Glu Tyr Cys Phe Asn Pro Thr Cys Thr Ala Cys
(SEQ ID NO: 6980)  Cys Glu Tyr Cys Phe Asn Pro Thr Cys Val Gly Cys
(SEQ ID NO: 6981)  Cys Glu Tyr Cys Phe Asn Pro Thr Cys Val Ala Cys
(SEQ ID NO: 6982)  Cys Glu Tyr Cys Phe Asn Pro Thr Cys Gly Gly Cys
(SEQ ID NO: 6983)  Cys Glu Tyr Cys Phe Asn Pro Thr Cys Gly Ala Cys
(SEQ ID NO: 6984)  Cys Glu Tyr Cys Phe Asn Gly Ala Cys Thr Gly Cys
(SEQ ID NO: 6985)  Cys Glu Tyr Cys Phe Asn Gly Ala Cys Thr Ala Cys
(SEQ ID NO: 6986)  Cys Glu Tyr Cys Phe Asn Gly Ala Cys Val Gly Cys
(SEQ ID NO: 6987)  Cys Glu Tyr Cys Phe Asn Gly Ala Cys Val Ala Cys
(SEQ ID NO: 6988)  Cys Glu Tyr Cys Phe Asn Gly Ala Cys Gly Gly Cys
(SEQ ID NO: 6989)  Cys Glu Tyr Cys Phe Asn Gly Ala Cys Gly Ala Cys
(SEQ ID NO: 6990)  Cys Glu Tyr Cys Phe Asn Gly Thr Cys Thr Gly Cys
(SEQ ID NO: 6991)  Cys Glu Tyr Cys Phe Asn Gly Thr Cys Thr Ala Cys
(SEQ ID NO: 6992)  Cys Glu Tyr Cys Phe Asn Gly Thr Cys Val Gly Cys
(SEQ ID NO: 6993)  Cys Glu Tyr Cys Phe Asn Gly Thr Cys Val Ala Cys
(SEQ ID NO: 6994)  Cys Glu Tyr Cys Phe Asn Gly Thr Cys Gly Gly Cys
(SEQ ID NO: 6995)  Cys Glu Tyr Cys Phe Asn Gly Thr Cys Gly Ala Cys
(SEQ ID NO: 6996)  Cys Glu Tyr Cys Pro Asn Pro Ala Cys Thr Gly Cys
(SEQ ID NO: 6997)  Cys Glu Tyr Cys Pro Asn Pro Ala Cys Thr Ala Cys
(SEQ ID NO: 6998)  Cys Glu Tyr Cys Pro Asn Pro Ala Cys Val Gly Cys
(SEQ ID NO: 6999)  Cys Glu Tyr Cys Pro Asn Pro Ala Cys Val Ala Cys

FIG. 3

(SEQ ID NO: 7000) Cys Glu Tyr Cys Pro Asn Pro Ala Cys Gly Gly Cys
(SEQ ID NO: 7001) Cys Glu Tyr Cys Pro Asn Pro Ala Cys Gly Ala Cys
(SEQ ID NO: 7002) Cys Glu Tyr Cys Pro Asn Pro Thr Cys Thr Gly Cys
(SEQ ID NO: 7003) Cys Glu Tyr Cys Pro Asn Pro Thr Cys Thr Ala Cys
(SEQ ID NO: 7004) Cys Glu Tyr Cys Pro Asn Pro Thr Cys Val Gly Cys
(SEQ ID NO: 7005) Cys Glu Tyr Cys Pro Asn Pro Thr Cys Val Ala Cys
(SEQ ID NO: 7006) Cys Glu Tyr Cys Pro Asn Pro Thr Cys Gly Gly Cys
(SEQ ID NO: 7007) Cys Glu Tyr Cys Pro Asn Pro Thr Cys Gly Ala Cys
(SEQ ID NO: 7008) Cys Glu Tyr Cys Pro Asn Gly Ala Cys Thr Gly Cys
(SEQ ID NO: 7009) Cys Glu Tyr Cys Pro Asn Gly Ala Cys Thr Ala Cys
(SEQ ID NO: 7010) Cys Glu Tyr Cys Pro Asn Gly Ala Cys Val Gly Cys
(SEQ ID NO: 7011) Cys Glu Tyr Cys Pro Asn Gly Ala Cys Val Ala Cys
(SEQ ID NO: 7012) Cys Glu Tyr Cys Pro Asn Gly Ala Cys Gly Gly Cys
(SEQ ID NO: 7013) Cys Glu Tyr Cys Pro Asn Gly Ala Cys Gly Ala Cys
(SEQ ID NO: 7014) Cys Glu Tyr Cys Pro Asn Gly Thr Cys Thr Gly Cys
(SEQ ID NO: 7015) Cys Glu Tyr Cys Pro Asn Gly Thr Cys Thr Ala Cys
(SEQ ID NO: 7016) Cys Glu Tyr Cys Pro Asn Gly Thr Cys Val Gly Cys
(SEQ ID NO: 7017) Cys Glu Tyr Cys Pro Asn Gly Thr Cys Val Ala Cys
(SEQ ID NO: 7018) Cys Glu Tyr Cys Pro Asn Gly Thr Cys Gly Gly Cys
(SEQ ID NO: 7019) Cys Glu Tyr Cys Pro Asn Gly Thr Cys Gly Ala Cys
(SEQ ID NO: 7020) Cys Glu Tyr Cys Ser Asn Pro Ala Cys Thr Gly Cys
(SEQ ID NO: 7021) Cys Glu Tyr Cys Ser Asn Pro Ala Cys Thr Ala Cys
(SEQ ID NO: 7022) Cys Glu Tyr Cys Ser Asn Pro Ala Cys Val Gly Cys
(SEQ ID NO: 7023) Cys Glu Tyr Cys Ser Asn Pro Ala Cys Val Ala Cys
(SEQ ID NO: 7024) Cys Glu Tyr Cys Ser Asn Pro Ala Cys Gly Gly Cys
(SEQ ID NO: 7025) Cys Glu Tyr Cys Ser Asn Pro Ala Cys Gly Ala Cys
(SEQ ID NO: 7026) Cys Glu Tyr Cys Ser Asn Pro Thr Cys Thr Gly Cys
(SEQ ID NO: 7027) Cys Glu Tyr Cys Ser Asn Pro Thr Cys Thr Ala Cys
(SEQ ID NO: 7028) Cys Glu Tyr Cys Ser Asn Pro Thr Cys Val Gly Cys
(SEQ ID NO: 7029) Cys Glu Tyr Cys Ser Asn Pro Thr Cys Val Ala Cys
(SEQ ID NO: 7030) Cys Glu Tyr Cys Ser Asn Pro Thr Cys Gly Gly Cys
(SEQ ID NO: 7031) Cys Glu Tyr Cys Ser Asn Pro Thr Cys Gly Ala Cys
(SEQ ID NO: 7032) Cys Glu Tyr Cys Ser Asn Gly Ala Cys Thr Gly Cys
(SEQ ID NO: 7033) Cys Glu Tyr Cys Ser Asn Gly Ala Cys Thr Ala Cys
(SEQ ID NO: 7034) Cys Glu Tyr Cys Ser Asn Gly Ala Cys Val Gly Cys
(SEQ ID NO: 7035) Cys Glu Tyr Cys Ser Asn Gly Ala Cys Val Ala Cys
(SEQ ID NO: 7036) Cys Glu Tyr Cys Ser Asn Gly Ala Cys Gly Gly Cys
(SEQ ID NO: 7037) Cys Glu Tyr Cys Ser Asn Gly Ala Cys Gly Ala Cys
(SEQ ID NO: 7038) Cys Glu Tyr Cys Ser Asn Gly Thr Cys Thr Gly Cys
(SEQ ID NO: 7039) Cys Glu Tyr Cys Ser Asn Gly Thr Cys Thr Ala Cys
(SEQ ID NO: 7040) Cys Glu Tyr Cys Ser Asn Gly Thr Cys Val Gly Cys
(SEQ ID NO: 7041) Cys Glu Tyr Cys Ser Asn Gly Thr Cys Val Ala Cys
(SEQ ID NO: 7042) Cys Glu Tyr Cys Ser Asn Gly Thr Cys Gly Gly Cys

FIG. 3

| | |
|---|---|
| (SEQ ID NO: 7043) | Cys Glu Tyr Cys Ser Asn Gly Thr Cys Gly Ala Cys |
| (SEQ ID NO: 7044) | Cys Glu Tyr Cys Thr Asn Pro Ala Cys Thr Gly Cys |
| (SEQ ID NO: 7045) | Cys Glu Tyr Cys Thr Asn Pro Ala Cys Thr Ala Cys |
| (SEQ ID NO: 7046) | Cys Glu Tyr Cys Thr Asn Pro Ala Cys Val Gly Cys |
| (SEQ ID NO: 7047) | Cys Glu Tyr Cys Thr Asn Pro Ala Cys Val Ala Cys |
| (SEQ ID NO: 7048) | Cys Glu Tyr Cys Thr Asn Pro Ala Cys Gly Gly Cys |
| (SEQ ID NO: 7049) | Cys Glu Tyr Cys Thr Asn Pro Ala Cys Gly Ala Cys |
| (SEQ ID NO: 7050) | Cys Glu Tyr Cys Thr Asn Pro Thr Cys Thr Gly Cys |
| (SEQ ID NO: 7051) | Cys Glu Tyr Cys Thr Asn Pro Thr Cys Thr Ala Cys |
| (SEQ ID NO: 7052) | Cys Glu Tyr Cys Thr Asn Pro Thr Cys Val Gly Cys |
| (SEQ ID NO: 7053) | Cys Glu Tyr Cys Thr Asn Pro Thr Cys Val Ala Cys |
| (SEQ ID NO: 7054) | Cys Glu Tyr Cys Thr Asn Pro Thr Cys Gly Gly Cys |
| (SEQ ID NO: 7055) | Cys Glu Tyr Cys Thr Asn Pro Thr Cys Gly Ala Cys |
| (SEQ ID NO: 7056) | Cys Glu Tyr Cys Thr Asn Gly Ala Cys Thr Gly Cys |
| (SEQ ID NO: 7057) | Cys Glu Tyr Cys Thr Asn Gly Ala Cys Thr Ala Cys |
| (SEQ ID NO: 7058) | Cys Glu Tyr Cys Thr Asn Gly Ala Cys Val Gly Cys |
| (SEQ ID NO: 7059) | Cys Glu Tyr Cys Thr Asn Gly Ala Cys Val Ala Cys |
| (SEQ ID NO: 7060) | Cys Glu Tyr Cys Thr Asn Gly Ala Cys Gly Gly Cys |
| (SEQ ID NO: 7061) | Cys Glu Tyr Cys Thr Asn Gly Ala Cys Gly Ala Cys |
| (SEQ ID NO: 7062) | Cys Glu Tyr Cys Thr Asn Gly Thr Cys Thr Gly Cys |
| (SEQ ID NO: 7063) | Cys Glu Tyr Cys Thr Asn Gly Thr Cys Thr Ala Cys |
| (SEQ ID NO: 7064) | Cys Glu Tyr Cys Thr Asn Gly Thr Cys Val Gly Cys |
| (SEQ ID NO: 7065) | Cys Glu Tyr Cys Thr Asn Gly Thr Cys Val Ala Cys |
| (SEQ ID NO: 7066) | Cys Glu Tyr Cys Thr Asn Gly Thr Cys Gly Gly Cys |
| (SEQ ID NO: 7067) | Cys Glu Tyr Cys Thr Asn Gly Thr Cys Gly Ala Cys |
| (SEQ ID NO: 7068) | Cys Glu Tyr Cys Trp Asn Pro Ala Cys Thr Gly Cys |
| (SEQ ID NO: 7069) | Cys Glu Tyr Cys Trp Asn Pro Ala Cys Thr Ala Cys |
| (SEQ ID NO: 7070) | Cys Glu Tyr Cys Trp Asn Pro Ala Cys Val Gly Cys |
| (SEQ ID NO: 7071) | Cys Glu Tyr Cys Trp Asn Pro Ala Cys Val Ala Cys |
| (SEQ ID NO: 7072) | Cys Glu Tyr Cys Trp Asn Pro Ala Cys Gly Gly Cys |
| (SEQ ID NO: 7073) | Cys Glu Tyr Cys Trp Asn Pro Ala Cys Gly Ala Cys |
| (SEQ ID NO: 7074) | Cys Glu Tyr Cys Trp Asn Pro Thr Cys Thr Gly Cys |
| (SEQ ID NO: 7075) | Cys Glu Tyr Cys Trp Asn Pro Thr Cys Thr Ala Cys |
| (SEQ ID NO: 7076) | Cys Glu Tyr Cys Trp Asn Pro Thr Cys Val Gly Cys |
| (SEQ ID NO: 7077) | Cys Glu Tyr Cys Trp Asn Pro Thr Cys Val Ala Cys |
| (SEQ ID NO: 7078) | Cys Glu Tyr Cys Trp Asn Pro Thr Cys Gly Gly Cys |
| (SEQ ID NO: 7079) | Cys Glu Tyr Cys Trp Asn Pro Thr Cys Gly Ala Cys |
| (SEQ ID NO: 7080) | Cys Glu Tyr Cys Trp Asn Gly Ala Cys Thr Gly Cys |
| (SEQ ID NO: 7081) | Cys Glu Tyr Cys Trp Asn Gly Ala Cys Thr Ala Cys |
| (SEQ ID NO: 7082) | Cys Glu Tyr Cys Trp Asn Gly Ala Cys Val Gly Cys |
| (SEQ ID NO: 7083) | Cys Glu Tyr Cys Trp Asn Gly Ala Cys Val Ala Cys |
| (SEQ ID NO: 7084) | Cys Glu Tyr Cys Trp Asn Gly Ala Cys Gly Gly Cys |
| (SEQ ID NO: 7085) | Cys Glu Tyr Cys Trp Asn Gly Ala Cys Gly Ala Cys |

FIG. 3

(SEQ ID NO: 7086) Cys Glu Tyr Cys Trp Asn Gly Thr Cys Thr Gly Cys
(SEQ ID NO: 7087) Cys Glu Tyr Cys Trp Asn Gly Thr Cys Thr Ala Cys
(SEQ ID NO: 7088) Cys Glu Tyr Cys Trp Asn Gly Thr Cys Val Gly Cys
(SEQ ID NO: 7089) Cys Glu Tyr Cys Trp Asn Gly Thr Cys Val Ala Cys
(SEQ ID NO: 7090) Cys Glu Tyr Cys Trp Asn Gly Thr Cys Gly Gly Cys
(SEQ ID NO: 7091) Cys Glu Tyr Cys Trp Asn Gly Thr Cys Gly Ala Cys
(SEQ ID NO: 7092) Cys Glu Tyr Cys Tyr Asn Pro Ala Cys Thr Gly Cys
(SEQ ID NO: 7093) Cys Glu Tyr Cys Tyr Asn Pro Ala Cys Thr Ala Cys
(SEQ ID NO: 7094) Cys Glu Tyr Cys Tyr Asn Pro Ala Cys Val Gly Cys
(SEQ ID NO: 7095) Cys Glu Tyr Cys Tyr Asn Pro Ala Cys Val Ala Cys
(SEQ ID NO: 7096) Cys Glu Tyr Cys Tyr Asn Pro Ala Cys Gly Gly Cys
(SEQ ID NO: 7097) Cys Glu Tyr Cys Tyr Asn Pro Ala Cys Gly Ala Cys
(SEQ ID NO: 7098) Cys Glu Tyr Cys Tyr Asn Pro Thr Cys Thr Gly Cys
(SEQ ID NO: 7099) Cys Glu Tyr Cys Tyr Asn Pro Thr Cys Thr Ala Cys
(SEQ ID NO: 7100) Cys Glu Tyr Cys Tyr Asn Pro Thr Cys Val Gly Cys
(SEQ ID NO: 7101) Cys Glu Tyr Cys Tyr Asn Pro Thr Cys Val Ala Cys
(SEQ ID NO: 7102) Cys Glu Tyr Cys Tyr Asn Pro Thr Cys Gly Gly Cys
(SEQ ID NO: 7103) Cys Glu Tyr Cys Tyr Asn Pro Thr Cys Gly Ala Cys
(SEQ ID NO: 7104) Cys Glu Tyr Cys Tyr Asn Gly Ala Cys Thr Gly Cys
(SEQ ID NO: 7105) Cys Glu Tyr Cys Tyr Asn Gly Ala Cys Thr Ala Cys
(SEQ ID NO: 7106) Cys Glu Tyr Cys Tyr Asn Gly Ala Cys Val Gly Cys
(SEQ ID NO: 7107) Cys Glu Tyr Cys Tyr Asn Gly Ala Cys Val Ala Cys
(SEQ ID NO: 7108) Cys Glu Tyr Cys Tyr Asn Gly Ala Cys Gly Gly Cys
(SEQ ID NO: 7109) Cys Glu Tyr Cys Tyr Asn Gly Ala Cys Gly Ala Cys
(SEQ ID NO: 7110) Cys Glu Tyr Cys Tyr Asn Gly Thr Cys Thr Gly Cys
(SEQ ID NO: 7111) Cys Glu Tyr Cys Tyr Asn Gly Thr Cys Thr Ala Cys
(SEQ ID NO: 7112) Cys Glu Tyr Cys Tyr Asn Gly Thr Cys Val Gly Cys
(SEQ ID NO: 7113) Cys Glu Tyr Cys Tyr Asn Gly Thr Cys Val Ala Cys
(SEQ ID NO: 7114) Cys Glu Tyr Cys Tyr Asn Gly Thr Cys Gly Gly Cys
(SEQ ID NO: 7115) Cys Glu Tyr Cys Tyr Asn Gly Thr Cys Gly Ala Cys
(SEQ ID NO: 7116) Cys Glu Tyr Cys Val Asn Pro Ala Cys Thr Gly Cys
(SEQ ID NO: 7117) Cys Glu Tyr Cys Val Asn Pro Ala Cys Thr Ala Cys
(SEQ ID NO: 7118) Cys Glu Tyr Cys Val Asn Pro Ala Cys Val Gly Cys
(SEQ ID NO: 7119) Cys Glu Tyr Cys Val Asn Pro Ala Cys Val Ala Cys
(SEQ ID NO: 7120) Cys Glu Tyr Cys Val Asn Pro Ala Cys Gly Gly Cys
(SEQ ID NO: 7121) Cys Glu Tyr Cys Val Asn Pro Ala Cys Gly Ala Cys
(SEQ ID NO: 7122) Cys Glu Tyr Cys Val Asn Pro Thr Cys Thr Gly Cys
(SEQ ID NO: 7123) Cys Glu Tyr Cys Val Asn Pro Thr Cys Thr Ala Cys
(SEQ ID NO: 7124) Cys Glu Tyr Cys Val Asn Pro Thr Cys Val Gly Cys
(SEQ ID NO: 7125) Cys Glu Tyr Cys Val Asn Pro Thr Cys Val Ala Cys
(SEQ ID NO: 7126) Cys Glu Tyr Cys Val Asn Pro Thr Cys Gly Gly Cys
(SEQ ID NO: 7127) Cys Glu Tyr Cys Val Asn Pro Thr Cys Gly Ala Cys
(SEQ ID NO: 7128) Cys Glu Tyr Cys Val Asn Gly Ala Cys Thr Gly Cys

FIG. 3

(SEQ ID NO: 7129)  Cys Glu Tyr Cys Val Asn Gly Ala Cys Thr Ala Cys
(SEQ ID NO: 7130)  Cys Glu Tyr Cys Val Asn Gly Ala Cys Val Gly Cys
(SEQ ID NO: 7131)  Cys Glu Tyr Cys Val Asn Gly Ala Cys Val Ala Cys
(SEQ ID NO: 7132)  Cys Glu Tyr Cys Val Asn Gly Ala Cys Gly Gly Cys
(SEQ ID NO: 7133)  Cys Glu Tyr Cys Val Asn Gly Ala Cys Gly Ala Cys
(SEQ ID NO: 7134)  Cys Glu Tyr Cys Val Asn Gly Thr Cys Thr Gly Cys
(SEQ ID NO: 7135)  Cys Glu Tyr Cys Val Asn Gly Thr Cys Thr Ala Cys
(SEQ ID NO: 7136)  Cys Glu Tyr Cys Val Asn Gly Thr Cys Val Gly Cys
(SEQ ID NO: 7137)  Cys Glu Tyr Cys Val Asn Gly Thr Cys Val Ala Cys
(SEQ ID NO: 7138)  Cys Glu Tyr Cys Val Asn Gly Thr Cys Gly Gly Cys
(SEQ ID NO: 7139)  Cys Glu Tyr Cys Val Asn Gly Thr Cys Gly Ala Cys
(SEQ ID NO: 7140)  Cys Glu Tyr Cys --- Asn Pro Ala Cys Thr Gly Cys
(SEQ ID NO: 7141)  Cys Glu Tyr Cys --- Asn Pro Ala Cys Thr Ala Cys
(SEQ ID NO: 7142)  Cys Glu Tyr Cys --- Asn Pro Ala Cys Val Gly Cys
(SEQ ID NO: 7143)  Cys Glu Tyr Cys --- Asn Pro Ala Cys Val Ala Cys
(SEQ ID NO: 7144)  Cys Glu Tyr Cys --- Asn Pro Ala Cys Gly Gly Cys
(SEQ ID NO: 7145)  Cys Glu Tyr Cys --- Asn Pro Ala Cys Gly Ala Cys
(SEQ ID NO: 7146)  Cys Glu Tyr Cys --- Asn Pro Thr Cys Thr Gly Cys
(SEQ ID NO: 7147)  Cys Glu Tyr Cys --- Asn Pro Thr Cys Thr Ala Cys
(SEQ ID NO: 7148)  Cys Glu Tyr Cys --- Asn Pro Thr Cys Val Gly Cys
(SEQ ID NO: 7149)  Cys Glu Tyr Cys --- Asn Pro Thr Cys Val Ala Cys
(SEQ ID NO: 7150)  Cys Glu Tyr Cys --- Asn Pro Thr Cys Gly Gly Cys
(SEQ ID NO: 7151)  Cys Glu Tyr Cys --- Asn Pro Thr Cys Gly Ala Cys
(SEQ ID NO: 7152)  Cys Glu Tyr Cys --- Asn Gly Ala Cys Thr Gly Cys
(SEQ ID NO: 7153)  Cys Glu Tyr Cys --- Asn Gly Ala Cys Thr Ala Cys
(SEQ ID NO: 7154)  Cys Glu Tyr Cys --- Asn Gly Ala Cys Val Gly Cys
(SEQ ID NO: 7155)  Cys Glu Tyr Cys --- Asn Gly Ala Cys Val Ala Cys
(SEQ ID NO: 7156)  Cys Glu Tyr Cys --- Asn Gly Ala Cys Gly Gly Cys
(SEQ ID NO: 7157)  Cys Glu Tyr Cys --- Asn Gly Ala Cys Gly Ala Cys
(SEQ ID NO: 7158)  Cys Glu Tyr Cys --- Asn Gly Thr Cys Thr Gly Cys
(SEQ ID NO: 7159)  Cys Glu Tyr Cys --- Asn Gly Thr Cys Thr Ala Cys
(SEQ ID NO: 7160)  Cys Glu Tyr Cys --- Asn Gly Thr Cys Val Gly Cys
(SEQ ID NO: 7161)  Cys Glu Tyr Cys --- Asn Gly Thr Cys Val Ala Cys
(SEQ ID NO: 7162)  Cys Glu Tyr Cys --- Asn Gly Thr Cys Gly Gly Cys
(SEQ ID NO: 7163)  Cys Glu Tyr Cys --- Asn Gly Thr Cys Gly Ala Cys
(SEQ ID NO: 7164)  Cys Glu Trp Cys Ala Asn Pro Ala Cys Thr Gly Cys
(SEQ ID NO: 7165)  Cys Glu Trp Cys Ala Asn Pro Ala Cys Thr Ala Cys
(SEQ ID NO: 7166)  Cys Glu Trp Cys Ala Asn Pro Ala Cys Val Gly Cys
(SEQ ID NO: 7167)  Cys Glu Trp Cys Ala Asn Pro Ala Cys Val Ala Cys
(SEQ ID NO: 7168)  Cys Glu Trp Cys Ala Asn Pro Ala Cys Gly Gly Cys
(SEQ ID NO: 7169)  Cys Glu Trp Cys Ala Asn Pro Ala Cys Gly Ala Cys
(SEQ ID NO: 7170)  Cys Glu Trp Cys Ala Asn Pro Thr Cys Thr Gly Cys
(SEQ ID NO: 7171)  Cys Glu Trp Cys Ala Asn Pro Thr Cys Thr Ala Cys

FIG. 3

| | |
|---|---|
| (SEQ ID NO: 7172) | Cys Glu Trp Cys Ala Asn Pro Thr Cys Val Gly Cys |
| (SEQ ID NO: 7173) | Cys Glu Trp Cys Ala Asn Pro Thr Cys Val Ala Cys |
| (SEQ ID NO: 7174) | Cys Glu Trp Cys Ala Asn Pro Thr Cys Gly Gly Cys |
| (SEQ ID NO: 7175) | Cys Glu Trp Cys Ala Asn Pro Thr Cys Gly Ala Cys |
| (SEQ ID NO: 7176) | Cys Glu Trp Cys Ala Asn Gly Ala Cys Thr Gly Cys |
| (SEQ ID NO: 7177) | Cys Glu Trp Cys Ala Asn Gly Ala Cys Thr Ala Cys |
| (SEQ ID NO: 7178) | Cys Glu Trp Cys Ala Asn Gly Ala Cys Val Gly Cys |
| (SEQ ID NO: 7179) | Cys Glu Trp Cys Ala Asn Gly Ala Cys Val Ala Cys |
| (SEQ ID NO: 7180) | Cys Glu Trp Cys Ala Asn Gly Ala Cys Gly Gly Cys |
| (SEQ ID NO: 7181) | Cys Glu Trp Cys Ala Asn Gly Ala Cys Gly Ala Cys |
| (SEQ ID NO: 7182) | Cys Glu Trp Cys Ala Asn Gly Thr Cys Thr Gly Cys |
| (SEQ ID NO: 7183) | Cys Glu Trp Cys Ala Asn Gly Thr Cys Thr Ala Cys |
| (SEQ ID NO: 7184) | Cys Glu Trp Cys Ala Asn Gly Thr Cys Val Gly Cys |
| (SEQ ID NO: 7185) | Cys Glu Trp Cys Ala Asn Gly Thr Cys Val Ala Cys |
| (SEQ ID NO: 7186) | Cys Glu Trp Cys Ala Asn Gly Thr Cys Gly Gly Cys |
| (SEQ ID NO: 7187) | Cys Glu Trp Cys Ala Asn Gly Thr Cys Gly Ala Cys |
| (SEQ ID NO: 7188) | Cys Glu Trp Cys Arg Asn Pro Ala Cys Thr Gly Cys |
| (SEQ ID NO: 7189) | Cys Glu Trp Cys Arg Asn Pro Ala Cys Thr Ala Cys |
| (SEQ ID NO: 7190) | Cys Glu Trp Cys Arg Asn Pro Ala Cys Val Gly Cys |
| (SEQ ID NO: 7191) | Cys Glu Trp Cys Arg Asn Pro Ala Cys Val Ala Cys |
| (SEQ ID NO: 7192) | Cys Glu Trp Cys Arg Asn Pro Ala Cys Gly Gly Cys |
| (SEQ ID NO: 7193) | Cys Glu Trp Cys Arg Asn Pro Ala Cys Gly Ala Cys |
| (SEQ ID NO: 7194) | Cys Glu Trp Cys Arg Asn Pro Thr Cys Thr Gly Cys |
| (SEQ ID NO: 7195) | Cys Glu Trp Cys Arg Asn Pro Thr Cys Thr Ala Cys |
| (SEQ ID NO: 7196) | Cys Glu Trp Cys Arg Asn Pro Thr Cys Val Gly Cys |
| (SEQ ID NO: 7197) | Cys Glu Trp Cys Arg Asn Pro Thr Cys Val Ala Cys |
| (SEQ ID NO: 7198) | Cys Glu Trp Cys Arg Asn Pro Thr Cys Gly Gly Cys |
| (SEQ ID NO: 7199) | Cys Glu Trp Cys Arg Asn Pro Thr Cys Gly Ala Cys |
| (SEQ ID NO: 7200) | Cys Glu Trp Cys Arg Asn Gly Ala Cys Thr Gly Cys |
| (SEQ ID NO: 7201) | Cys Glu Trp Cys Arg Asn Gly Ala Cys Thr Ala Cys |
| (SEQ ID NO: 7202) | Cys Glu Trp Cys Arg Asn Gly Ala Cys Val Gly Cys |
| (SEQ ID NO: 7203) | Cys Glu Trp Cys Arg Asn Gly Ala Cys Val Ala Cys |
| (SEQ ID NO: 7204) | Cys Glu Trp Cys Arg Asn Gly Ala Cys Gly Gly Cys |
| (SEQ ID NO: 7205) | Cys Glu Trp Cys Arg Asn Gly Ala Cys Gly Ala Cys |
| (SEQ ID NO: 7206) | Cys Glu Trp Cys Arg Asn Gly Thr Cys Thr Gly Cys |
| (SEQ ID NO: 7207) | Cys Glu Trp Cys Arg Asn Gly Thr Cys Thr Ala Cys |
| (SEQ ID NO: 7208) | Cys Glu Trp Cys Arg Asn Gly Thr Cys Val Gly Cys |
| (SEQ ID NO: 7209) | Cys Glu Trp Cys Arg Asn Gly Thr Cys Val Ala Cys |
| (SEQ ID NO: 7210) | Cys Glu Trp Cys Arg Asn Gly Thr Cys Gly Gly Cys |
| (SEQ ID NO: 7211) | Cys Glu Trp Cys Arg Asn Gly Thr Cys Gly Ala Cys |
| (SEQ ID NO: 7212) | Cys Glu Trp Cys Asn Asn Pro Ala Cys Thr Gly Cys |
| (SEQ ID NO: 7213) | Cys Glu Trp Cys Asn Asn Pro Ala Cys Thr Ala Cys |
| (SEQ ID NO: 7214) | Cys Glu Trp Cys Asn Asn Pro Ala Cys Val Gly Cys |

FIG. 3

(SEQ ID NO: 7215)  Cys Glu Trp Cys Asn Asn Pro Ala Cys Val Ala Cys
(SEQ ID NO: 7216)  Cys Glu Trp Cys Asn Asn Pro Ala Cys Gly Gly Cys
(SEQ ID NO: 7217)  Cys Glu Trp Cys Asn Asn Pro Ala Cys Gly Ala Cys
(SEQ ID NO: 7218)  Cys Glu Trp Cys Asn Asn Pro Thr Cys Thr Gly Cys
(SEQ ID NO: 7219)  Cys Glu Trp Cys Asn Asn Pro Thr Cys Thr Ala Cys
(SEQ ID NO: 7220)  Cys Glu Trp Cys Asn Asn Pro Thr Cys Val Gly Cys
(SEQ ID NO: 7221)  Cys Glu Trp Cys Asn Asn Pro Thr Cys Val Ala Cys
(SEQ ID NO: 7222)  Cys Glu Trp Cys Asn Asn Pro Thr Cys Gly Gly Cys
(SEQ ID NO: 7223)  Cys Glu Trp Cys Asn Asn Pro Thr Cys Gly Ala Cys
(SEQ ID NO: 7224)  Cys Glu Trp Cys Asn Asn Gly Ala Cys Thr Gly Cys
(SEQ ID NO: 7225)  Cys Glu Trp Cys Asn Asn Gly Ala Cys Thr Ala Cys
(SEQ ID NO: 7226)  Cys Glu Trp Cys Asn Asn Gly Ala Cys Val Gly Cys
(SEQ ID NO: 7227)  Cys Glu Trp Cys Asn Asn Gly Ala Cys Val Ala Cys
(SEQ ID NO: 7228)  Cys Glu Trp Cys Asn Asn Gly Ala Cys Gly Gly Cys
(SEQ ID NO: 7229)  Cys Glu Trp Cys Asn Asn Gly Ala Cys Gly Ala Cys
(SEQ ID NO: 7230)  Cys Glu Trp Cys Asn Asn Gly Thr Cys Thr Gly Cys
(SEQ ID NO: 7231)  Cys Glu Trp Cys Asn Asn Gly Thr Cys Thr Ala Cys
(SEQ ID NO: 7232)  Cys Glu Trp Cys Asn Asn Gly Thr Cys Val Gly Cys
(SEQ ID NO: 7233)  Cys Glu Trp Cys Asn Asn Gly Thr Cys Val Ala Cys
(SEQ ID NO: 7234)  Cys Glu Trp Cys Asn Asn Gly Thr Cys Gly Gly Cys
(SEQ ID NO: 7235)  Cys Glu Trp Cys Asn Asn Gly Thr Cys Gly Ala Cys
(SEQ ID NO: 7236)  Cys Glu Trp Cys Asp Asn Pro Ala Cys Thr Gly Cys
(SEQ ID NO: 7237)  Cys Glu Trp Cys Asp Asn Pro Ala Cys Thr Ala Cys
(SEQ ID NO: 7238)  Cys Glu Trp Cys Asp Asn Pro Ala Cys Val Gly Cys
(SEQ ID NO: 7239)  Cys Glu Trp Cys Asp Asn Pro Ala Cys Val Ala Cys
(SEQ ID NO: 7240)  Cys Glu Trp Cys Asp Asn Pro Ala Cys Gly Gly Cys
(SEQ ID NO: 7241)  Cys Glu Trp Cys Asp Asn Pro Ala Cys Gly Ala Cys
(SEQ ID NO: 7242)  Cys Glu Trp Cys Asp Asn Pro Thr Cys Thr Gly Cys
(SEQ ID NO: 7243)  Cys Glu Trp Cys Asp Asn Pro Thr Cys Thr Ala Cys
(SEQ ID NO: 7244)  Cys Glu Trp Cys Asp Asn Pro Thr Cys Val Gly Cys
(SEQ ID NO: 7245)  Cys Glu Trp Cys Asp Asn Pro Thr Cys Val Ala Cys
(SEQ ID NO: 7246)  Cys Glu Trp Cys Asp Asn Pro Thr Cys Gly Gly Cys
(SEQ ID NO: 7247)  Cys Glu Trp Cys Asp Asn Pro Thr Cys Gly Ala Cys
(SEQ ID NO: 7248)  Cys Glu Trp Cys Asp Asn Gly Ala Cys Thr Gly Cys
(SEQ ID NO: 7249)  Cys Glu Trp Cys Asp Asn Gly Ala Cys Thr Ala Cys
(SEQ ID NO: 7250)  Cys Glu Trp Cys Asp Asn Gly Ala Cys Val Gly Cys
(SEQ ID NO: 7251)  Cys Glu Trp Cys Asp Asn Gly Ala Cys Val Ala Cys
(SEQ ID NO: 7252)  Cys Glu Trp Cys Asp Asn Gly Ala Cys Gly Gly Cys
(SEQ ID NO: 7253)  Cys Glu Trp Cys Asp Asn Gly Ala Cys Gly Ala Cys
(SEQ ID NO: 7254)  Cys Glu Trp Cys Asp Asn Gly Thr Cys Thr Gly Cys
(SEQ ID NO: 7255)  Cys Glu Trp Cys Asp Asn Gly Thr Cys Thr Ala Cys
(SEQ ID NO: 7256)  Cys Glu Trp Cys Asp Asn Gly Thr Cys Val Gly Cys
(SEQ ID NO: 7257)  Cys Glu Trp Cys Asp Asn Gly Thr Cys Val Ala Cys

FIG. 3

| | |
|---|---|
| (SEQ ID NO: 7258) | Cys Glu Trp Cys Asp Asn Gly Thr Cys Gly Gly Cys |
| (SEQ ID NO: 7259) | Cys Glu Trp Cys Asp Asn Gly Thr Cys Gly Ala Cys |
| (SEQ ID NO: 7260) | Cys Glu Trp Cys Gln Asn Pro Ala Cys Thr Gly Cys |
| (SEQ ID NO: 7261) | Cys Glu Trp Cys Gln Asn Pro Ala Cys Thr Ala Cys |
| (SEQ ID NO: 7262) | Cys Glu Trp Cys Gln Asn Pro Ala Cys Val Gly Cys |
| (SEQ ID NO: 7263) | Cys Glu Trp Cys Gln Asn Pro Ala Cys Val Ala Cys |
| (SEQ ID NO: 7264) | Cys Glu Trp Cys Gln Asn Pro Ala Cys Gly Gly Cys |
| (SEQ ID NO: 7265) | Cys Glu Trp Cys Gln Asn Pro Ala Cys Gly Ala Cys |
| (SEQ ID NO: 7266) | Cys Glu Trp Cys Gln Asn Pro Thr Cys Thr Gly Cys |
| (SEQ ID NO: 7267) | Cys Glu Trp Cys Gln Asn Pro Thr Cys Thr Ala Cys |
| (SEQ ID NO: 7268) | Cys Glu Trp Cys Gln Asn Pro Thr Cys Val Gly Cys |
| (SEQ ID NO: 7269) | Cys Glu Trp Cys Gln Asn Pro Thr Cys Val Ala Cys |
| (SEQ ID NO: 7270) | Cys Glu Trp Cys Gln Asn Pro Thr Cys Gly Gly Cys |
| (SEQ ID NO: 7271) | Cys Glu Trp Cys Gln Asn Pro Thr Cys Gly Ala Cys |
| (SEQ ID NO: 7272) | Cys Glu Trp Cys Gln Asn Gly Ala Cys Thr Gly Cys |
| (SEQ ID NO: 7273) | Cys Glu Trp Cys Gln Asn Gly Ala Cys Thr Ala Cys |
| (SEQ ID NO: 7274) | Cys Glu Trp Cys Gln Asn Gly Ala Cys Val Gly Cys |
| (SEQ ID NO: 7275) | Cys Glu Trp Cys Gln Asn Gly Ala Cys Val Ala Cys |
| (SEQ ID NO: 7276) | Cys Glu Trp Cys Gln Asn Gly Ala Cys Gly Gly Cys |
| (SEQ ID NO: 7277) | Cys Glu Trp Cys Gln Asn Gly Ala Cys Gly Ala Cys |
| (SEQ ID NO: 7278) | Cys Glu Trp Cys Gln Asn Gly Thr Cys Thr Gly Cys |
| (SEQ ID NO: 7279) | Cys Glu Trp Cys Gln Asn Gly Thr Cys Thr Ala Cys |
| (SEQ ID NO: 7280) | Cys Glu Trp Cys Gln Asn Gly Thr Cys Val Gly Cys |
| (SEQ ID NO: 7281) | Cys Glu Trp Cys Gln Asn Gly Thr Cys Val Ala Cys |
| (SEQ ID NO: 7282) | Cys Glu Trp Cys Gln Asn Gly Thr Cys Gly Gly Cys |
| (SEQ ID NO: 7283) | Cys Glu Trp Cys Gln Asn Gly Thr Cys Gly Ala Cys |
| (SEQ ID NO: 7284) | Cys Glu Trp Cys Glu Asn Pro Ala Cys Thr Gly Cys |
| (SEQ ID NO: 7285) | Cys Glu Trp Cys Glu Asn Pro Ala Cys Thr Ala Cys |
| (SEQ ID NO: 7286) | Cys Glu Trp Cys Glu Asn Pro Ala Cys Val Gly Cys |
| (SEQ ID NO: 7287) | Cys Glu Trp Cys Glu Asn Pro Ala Cys Val Ala Cys |
| (SEQ ID NO: 7288) | Cys Glu Trp Cys Glu Asn Pro Ala Cys Gly Gly Cys |
| (SEQ ID NO: 7289) | Cys Glu Trp Cys Glu Asn Pro Ala Cys Gly Ala Cys |
| (SEQ ID NO: 7290) | Cys Glu Trp Cys Glu Asn Pro Thr Cys Thr Gly Cys |
| (SEQ ID NO: 7291) | Cys Glu Trp Cys Glu Asn Pro Thr Cys Thr Ala Cys |
| (SEQ ID NO: 7292) | Cys Glu Trp Cys Glu Asn Pro Thr Cys Val Gly Cys |
| (SEQ ID NO: 7293) | Cys Glu Trp Cys Glu Asn Pro Thr Cys Val Ala Cys |
| (SEQ ID NO: 7294) | Cys Glu Trp Cys Glu Asn Pro Thr Cys Gly Gly Cys |
| (SEQ ID NO: 7295) | Cys Glu Trp Cys Glu Asn Pro Thr Cys Gly Ala Cys |
| (SEQ ID NO: 7296) | Cys Glu Trp Cys Glu Asn Gly Ala Cys Thr Gly Cys |
| (SEQ ID NO: 7297) | Cys Glu Trp Cys Glu Asn Gly Ala Cys Thr Ala Cys |
| (SEQ ID NO: 7298) | Cys Glu Trp Cys Glu Asn Gly Ala Cys Val Gly Cys |
| (SEQ ID NO: 7299) | Cys Glu Trp Cys Glu Asn Gly Ala Cys Val Ala Cys |
| (SEQ ID NO: 7300) | Cys Glu Trp Cys Glu Asn Gly Ala Cys Gly Gly Cys |

FIG. 3

(SEQ ID NO: 7301)  Cys Glu Trp Cys Glu Asn Gly Ala Cys Gly Ala Cys
(SEQ ID NO: 7302)  Cys Glu Trp Cys Glu Asn Gly Thr Cys Thr Gly Cys
(SEQ ID NO: 7303)  Cys Glu Trp Cys Glu Asn Gly Thr Cys Thr Ala Cys
(SEQ ID NO: 7304)  Cys Glu Trp Cys Glu Asn Gly Thr Cys Val Gly Cys
(SEQ ID NO: 7305)  Cys Glu Trp Cys Glu Asn Gly Thr Cys Val Ala Cys
(SEQ ID NO: 7306)  Cys Glu Trp Cys Glu Asn Gly Thr Cys Gly Gly Cys
(SEQ ID NO: 7307)  Cys Glu Trp Cys Glu Asn Gly Thr Cys Gly Ala Cys
(SEQ ID NO: 7308)  Cys Glu Trp Cys Gly Asn Pro Ala Cys Thr Gly Cys
(SEQ ID NO: 7309)  Cys Glu Trp Cys Gly Asn Pro Ala Cys Thr Ala Cys
(SEQ ID NO: 7310)  Cys Glu Trp Cys Gly Asn Pro Ala Cys Val Gly Cys
(SEQ ID NO: 7311)  Cys Glu Trp Cys Gly Asn Pro Ala Cys Val Ala Cys
(SEQ ID NO: 7312)  Cys Glu Trp Cys Gly Asn Pro Ala Cys Gly Gly Cys
(SEQ ID NO: 7313)  Cys Glu Trp Cys Gly Asn Pro Ala Cys Gly Ala Cys
(SEQ ID NO: 7314)  Cys Glu Trp Cys Gly Asn Pro Thr Cys Thr Gly Cys
(SEQ ID NO: 7315)  Cys Glu Trp Cys Gly Asn Pro Thr Cys Thr Ala Cys
(SEQ ID NO: 7316)  Cys Glu Trp Cys Gly Asn Pro Thr Cys Val Gly Cys
(SEQ ID NO: 7317)  Cys Glu Trp Cys Gly Asn Pro Thr Cys Val Ala Cys
(SEQ ID NO: 7318)  Cys Glu Trp Cys Gly Asn Pro Thr Cys Gly Gly Cys
(SEQ ID NO: 7319)  Cys Glu Trp Cys Gly Asn Pro Thr Cys Gly Ala Cys
(SEQ ID NO: 7320)  Cys Glu Trp Cys Gly Asn Gly Ala Cys Thr Gly Cys
(SEQ ID NO: 7321)  Cys Glu Trp Cys Gly Asn Gly Ala Cys Thr Ala Cys
(SEQ ID NO: 7322)  Cys Glu Trp Cys Gly Asn Gly Ala Cys Val Gly Cys
(SEQ ID NO: 7323)  Cys Glu Trp Cys Gly Asn Gly Ala Cys Val Ala Cys
(SEQ ID NO: 7324)  Cys Glu Trp Cys Gly Asn Gly Ala Cys Gly Gly Cys
(SEQ ID NO: 7325)  Cys Glu Trp Cys Gly Asn Gly Ala Cys Gly Ala Cys
(SEQ ID NO: 7326)  Cys Glu Trp Cys Gly Asn Gly Thr Cys Thr Gly Cys
(SEQ ID NO: 7327)  Cys Glu Trp Cys Gly Asn Gly Thr Cys Thr Ala Cys
(SEQ ID NO: 7328)  Cys Glu Trp Cys Gly Asn Gly Thr Cys Val Gly Cys
(SEQ ID NO: 7329)  Cys Glu Trp Cys Gly Asn Gly Thr Cys Val Ala Cys
(SEQ ID NO: 7330)  Cys Glu Trp Cys Gly Asn Gly Thr Cys Gly Gly Cys
(SEQ ID NO: 7331)  Cys Glu Trp Cys Gly Asn Gly Thr Cys Gly Ala Cys
(SEQ ID NO: 7332)  Cys Glu Trp Cys His Asn Pro Ala Cys Thr Gly Cys
(SEQ ID NO: 7333)  Cys Glu Trp Cys His Asn Pro Ala Cys Thr Ala Cys
(SEQ ID NO: 7334)  Cys Glu Trp Cys His Asn Pro Ala Cys Val Gly Cys
(SEQ ID NO: 7335)  Cys Glu Trp Cys His Asn Pro Ala Cys Val Ala Cys
(SEQ ID NO: 7336)  Cys Glu Trp Cys His Asn Pro Ala Cys Gly Gly Cys
(SEQ ID NO: 7337)  Cys Glu Trp Cys His Asn Pro Ala Cys Gly Ala Cys
(SEQ ID NO: 7338)  Cys Glu Trp Cys His Asn Pro Thr Cys Thr Gly Cys
(SEQ ID NO: 7339)  Cys Glu Trp Cys His Asn Pro Thr Cys Thr Ala Cys
(SEQ ID NO: 7340)  Cys Glu Trp Cys His Asn Pro Thr Cys Val Gly Cys
(SEQ ID NO: 7341)  Cys Glu Trp Cys His Asn Pro Thr Cys Val Ala Cys
(SEQ ID NO: 7342)  Cys Glu Trp Cys His Asn Pro Thr Cys Gly Gly Cys
(SEQ ID NO: 7343)  Cys Glu Trp Cys His Asn Pro Thr Cys Gly Ala Cys

FIG. 3

| | |
|---|---|
| (SEQ ID NO: 7344) | Cys Glu Trp Cys His Asn Gly Ala Cys Thr Gly Cys |
| (SEQ ID NO: 7345) | Cys Glu Trp Cys His Asn Gly Ala Cys Thr Ala Cys |
| (SEQ ID NO: 7346) | Cys Glu Trp Cys His Asn Gly Ala Cys Val Gly Cys |
| (SEQ ID NO: 7347) | Cys Glu Trp Cys His Asn Gly Ala Cys Val Ala Cys |
| (SEQ ID NO: 7348) | Cys Glu Trp Cys His Asn Gly Ala Cys Gly Gly Cys |
| (SEQ ID NO: 7349) | Cys Glu Trp Cys His Asn Gly Ala Cys Gly Ala Cys |
| (SEQ ID NO: 7350) | Cys Glu Trp Cys His Asn Gly Thr Cys Thr Gly Cys |
| (SEQ ID NO: 7351) | Cys Glu Trp Cys His Asn Gly Thr Cys Thr Ala Cys |
| (SEQ ID NO: 7352) | Cys Glu Trp Cys His Asn Gly Thr Cys Val Gly Cys |
| (SEQ ID NO: 7353) | Cys Glu Trp Cys His Asn Gly Thr Cys Val Ala Cys |
| (SEQ ID NO: 7354) | Cys Glu Trp Cys His Asn Gly Thr Cys Gly Gly Cys |
| (SEQ ID NO: 7355) | Cys Glu Trp Cys His Asn Gly Thr Cys Gly Ala Cys |
| (SEQ ID NO: 7356) | Cys Glu Trp Cys Ile Asn Pro Ala Cys Thr Gly Cys |
| (SEQ ID NO: 7357) | Cys Glu Trp Cys Ile Asn Pro Ala Cys Thr Ala Cys |
| (SEQ ID NO: 7358) | Cys Glu Trp Cys Ile Asn Pro Ala Cys Val Gly Cys |
| (SEQ ID NO: 7359) | Cys Glu Trp Cys Ile Asn Pro Ala Cys Val Ala Cys |
| (SEQ ID NO: 7360) | Cys Glu Trp Cys Ile Asn Pro Ala Cys Gly Gly Cys |
| (SEQ ID NO: 7361) | Cys Glu Trp Cys Ile Asn Pro Ala Cys Gly Ala Cys |
| (SEQ ID NO: 7362) | Cys Glu Trp Cys Ile Asn Pro Thr Cys Thr Gly Cys |
| (SEQ ID NO: 7363) | Cys Glu Trp Cys Ile Asn Pro Thr Cys Thr Ala Cys |
| (SEQ ID NO: 7364) | Cys Glu Trp Cys Ile Asn Pro Thr Cys Val Gly Cys |
| (SEQ ID NO: 7365) | Cys Glu Trp Cys Ile Asn Pro Thr Cys Val Ala Cys |
| (SEQ ID NO: 7366) | Cys Glu Trp Cys Ile Asn Pro Thr Cys Gly Gly Cys |
| (SEQ ID NO: 7367) | Cys Glu Trp Cys Ile Asn Pro Thr Cys Gly Ala Cys |
| (SEQ ID NO: 7368) | Cys Glu Trp Cys Ile Asn Gly Ala Cys Thr Gly Cys |
| (SEQ ID NO: 7369) | Cys Glu Trp Cys Ile Asn Gly Ala Cys Thr Ala Cys |
| (SEQ ID NO: 7370) | Cys Glu Trp Cys Ile Asn Gly Ala Cys Val Gly Cys |
| (SEQ ID NO: 7371) | Cys Glu Trp Cys Ile Asn Gly Ala Cys Val Ala Cys |
| (SEQ ID NO: 7372) | Cys Glu Trp Cys Ile Asn Gly Ala Cys Gly Gly Cys |
| (SEQ ID NO: 7373) | Cys Glu Trp Cys Ile Asn Gly Ala Cys Gly Ala Cys |
| (SEQ ID NO: 7374) | Cys Glu Trp Cys Ile Asn Gly Thr Cys Thr Gly Cys |
| (SEQ ID NO: 7375) | Cys Glu Trp Cys Ile Asn Gly Thr Cys Thr Ala Cys |
| (SEQ ID NO: 7376) | Cys Glu Trp Cys Ile Asn Gly Thr Cys Val Gly Cys |
| (SEQ ID NO: 7377) | Cys Glu Trp Cys Ile Asn Gly Thr Cys Val Ala Cys |
| (SEQ ID NO: 7378) | Cys Glu Trp Cys Ile Asn Gly Thr Cys Gly Gly Cys |
| (SEQ ID NO: 7379) | Cys Glu Trp Cys Ile Asn Gly Thr Cys Gly Ala Cys |
| (SEQ ID NO: 7380) | Cys Glu Trp Cys Leu Asn Pro Ala Cys Thr Gly Cys |
| (SEQ ID NO: 7381) | Cys Glu Trp Cys Leu Asn Pro Ala Cys Thr Ala Cys |
| (SEQ ID NO: 7382) | Cys Glu Trp Cys Leu Asn Pro Ala Cys Val Gly Cys |
| (SEQ ID NO: 7383) | Cys Glu Trp Cys Leu Asn Pro Ala Cys Val Ala Cys |
| (SEQ ID NO: 7384) | Cys Glu Trp Cys Leu Asn Pro Ala Cys Gly Gly Cys |
| (SEQ ID NO: 7385) | Cys Glu Trp Cys Leu Asn Pro Ala Cys Gly Ala Cys |
| (SEQ ID NO: 7386) | Cys Glu Trp Cys Leu Asn Pro Thr Cys Thr Gly Cys |

FIG. 3

| | |
|---|---|
| (SEQ ID NO: 7387) | Cys Glu Trp Cys Leu Asn Pro Thr Cys Thr Ala Cys |
| (SEQ ID NO: 7388) | Cys Glu Trp Cys Leu Asn Pro Thr Cys Val Gly Cys |
| (SEQ ID NO: 7389) | Cys Glu Trp Cys Leu Asn Pro Thr Cys Val Ala Cys |
| (SEQ ID NO: 7390) | Cys Glu Trp Cys Leu Asn Pro Thr Cys Gly Gly Cys |
| (SEQ ID NO: 7391) | Cys Glu Trp Cys Leu Asn Pro Thr Cys Gly Ala Cys |
| (SEQ ID NO: 7392) | Cys Glu Trp Cys Leu Asn Gly Ala Cys Thr Gly Cys |
| (SEQ ID NO: 7393) | Cys Glu Trp Cys Leu Asn Gly Ala Cys Thr Ala Cys |
| (SEQ ID NO: 7394) | Cys Glu Trp Cys Leu Asn Gly Ala Cys Val Gly Cys |
| (SEQ ID NO: 7395) | Cys Glu Trp Cys Leu Asn Gly Ala Cys Val Ala Cys |
| (SEQ ID NO: 7396) | Cys Glu Trp Cys Leu Asn Gly Ala Cys Gly Gly Cys |
| (SEQ ID NO: 7397) | Cys Glu Trp Cys Leu Asn Gly Ala Cys Gly Ala Cys |
| (SEQ ID NO: 7398) | Cys Glu Trp Cys Leu Asn Gly Thr Cys Thr Gly Cys |
| (SEQ ID NO: 7399) | Cys Glu Trp Cys Leu Asn Gly Thr Cys Thr Ala Cys |
| (SEQ ID NO: 7400) | Cys Glu Trp Cys Leu Asn Gly Thr Cys Val Gly Cys |
| (SEQ ID NO: 7401) | Cys Glu Trp Cys Leu Asn Gly Thr Cys Val Ala Cys |
| (SEQ ID NO: 7402) | Cys Glu Trp Cys Leu Asn Gly Thr Cys Gly Gly Cys |
| (SEQ ID NO: 7403) | Cys Glu Trp Cys Leu Asn Gly Thr Cys Gly Ala Cys |
| (SEQ ID NO: 7404) | Cys Glu Trp Cys Lys Asn Pro Ala Cys Thr Gly Cys |
| (SEQ ID NO: 7405) | Cys Glu Trp Cys Lys Asn Pro Ala Cys Thr Ala Cys |
| (SEQ ID NO: 7406) | Cys Glu Trp Cys Lys Asn Pro Ala Cys Val Gly Cys |
| (SEQ ID NO: 7407) | Cys Glu Trp Cys Lys Asn Pro Ala Cys Val Ala Cys |
| (SEQ ID NO: 7408) | Cys Glu Trp Cys Lys Asn Pro Ala Cys Gly Gly Cys |
| (SEQ ID NO: 7409) | Cys Glu Trp Cys Lys Asn Pro Ala Cys Gly Ala Cys |
| (SEQ ID NO: 7410) | Cys Glu Trp Cys Lys Asn Pro Thr Cys Thr Gly Cys |
| (SEQ ID NO: 7411) | Cys Glu Trp Cys Lys Asn Pro Thr Cys Thr Ala Cys |
| (SEQ ID NO: 7412) | Cys Glu Trp Cys Lys Asn Pro Thr Cys Val Gly Cys |
| (SEQ ID NO: 7413) | Cys Glu Trp Cys Lys Asn Pro Thr Cys Val Ala Cys |
| (SEQ ID NO: 7414) | Cys Glu Trp Cys Lys Asn Pro Thr Cys Gly Gly Cys |
| (SEQ ID NO: 7415) | Cys Glu Trp Cys Lys Asn Pro Thr Cys Gly Ala Cys |
| (SEQ ID NO: 7416) | Cys Glu Trp Cys Lys Asn Gly Ala Cys Thr Gly Cys |
| (SEQ ID NO: 7417) | Cys Glu Trp Cys Lys Asn Gly Ala Cys Thr Ala Cys |
| (SEQ ID NO: 7418) | Cys Glu Trp Cys Lys Asn Gly Ala Cys Val Gly Cys |
| (SEQ ID NO: 7419) | Cys Glu Trp Cys Lys Asn Gly Ala Cys Val Ala Cys |
| (SEQ ID NO: 7420) | Cys Glu Trp Cys Lys Asn Gly Ala Cys Gly Gly Cys |
| (SEQ ID NO: 7421) | Cys Glu Trp Cys Lys Asn Gly Ala Cys Gly Ala Cys |
| (SEQ ID NO: 7422) | Cys Glu Trp Cys Lys Asn Gly Thr Cys Thr Gly Cys |
| (SEQ ID NO: 7423) | Cys Glu Trp Cys Lys Asn Gly Thr Cys Thr Ala Cys |
| (SEQ ID NO: 7424) | Cys Glu Trp Cys Lys Asn Gly Thr Cys Val Gly Cys |
| (SEQ ID NO: 7425) | Cys Glu Trp Cys Lys Asn Gly Thr Cys Val Ala Cys |
| (SEQ ID NO: 7426) | Cys Glu Trp Cys Lys Asn Gly Thr Cys Gly Gly Cys |
| (SEQ ID NO: 7427) | Cys Glu Trp Cys Lys Asn Gly Thr Cys Gly Ala Cys |
| (SEQ ID NO: 7428) | Cys Glu Trp Cys Met Asn Pro Ala Cys Thr Gly Cys |
| (SEQ ID NO: 7429) | Cys Glu Trp Cys Met Asn Pro Ala Cys Thr Ala Cys |

FIG. 3

(SEQ ID NO: 7430)   Cys Glu Trp Cys Met Asn Pro Ala Cys Val Gly Cys
(SEQ ID NO: 7431)   Cys Glu Trp Cys Met Asn Pro Ala Cys Val Ala Cys
(SEQ ID NO: 7432)   Cys Glu Trp Cys Met Asn Pro Ala Cys Gly Gly Cys
(SEQ ID NO: 7433)   Cys Glu Trp Cys Met Asn Pro Ala Cys Gly Ala Cys
(SEQ ID NO: 7434)   Cys Glu Trp Cys Met Asn Pro Thr Cys Thr Gly Cys
(SEQ ID NO: 7435)   Cys Glu Trp Cys Met Asn Pro Thr Cys Thr Ala Cys
(SEQ ID NO: 7436)   Cys Glu Trp Cys Met Asn Pro Thr Cys Val Gly Cys
(SEQ ID NO: 7437)   Cys Glu Trp Cys Met Asn Pro Thr Cys Val Ala Cys
(SEQ ID NO: 7438)   Cys Glu Trp Cys Met Asn Pro Thr Cys Gly Gly Cys
(SEQ ID NO: 7439)   Cys Glu Trp Cys Met Asn Pro Thr Cys Gly Ala Cys
(SEQ ID NO: 7440)   Cys Glu Trp Cys Met Asn Gly Ala Cys Thr Gly Cys
(SEQ ID NO: 7441)   Cys Glu Trp Cys Met Asn Gly Ala Cys Thr Ala Cys
(SEQ ID NO: 7442)   Cys Glu Trp Cys Met Asn Gly Ala Cys Val Gly Cys
(SEQ ID NO: 7443)   Cys Glu Trp Cys Met Asn Gly Ala Cys Val Ala Cys
(SEQ ID NO: 7444)   Cys Glu Trp Cys Met Asn Gly Ala Cys Gly Gly Cys
(SEQ ID NO: 7445)   Cys Glu Trp Cys Met Asn Gly Ala Cys Gly Ala Cys
(SEQ ID NO: 7446)   Cys Glu Trp Cys Met Asn Gly Thr Cys Thr Gly Cys
(SEQ ID NO: 7447)   Cys Glu Trp Cys Met Asn Gly Thr Cys Thr Ala Cys
(SEQ ID NO: 7448)   Cys Glu Trp Cys Met Asn Gly Thr Cys Val Gly Cys
(SEQ ID NO: 7449)   Cys Glu Trp Cys Met Asn Gly Thr Cys Val Ala Cys
(SEQ ID NO: 7450)   Cys Glu Trp Cys Met Asn Gly Thr Cys Gly Gly Cys
(SEQ ID NO: 7451)   Cys Glu Trp Cys Met Asn Gly Thr Cys Gly Ala Cys
(SEQ ID NO: 7452)   Cys Glu Trp Cys Phe Asn Pro Ala Cys Thr Gly Cys
(SEQ ID NO: 7453)   Cys Glu Trp Cys Phe Asn Pro Ala Cys Thr Ala Cys
(SEQ ID NO: 7454)   Cys Glu Trp Cys Phe Asn Pro Ala Cys Val Gly Cys
(SEQ ID NO: 7455)   Cys Glu Trp Cys Phe Asn Pro Ala Cys Val Ala Cys
(SEQ ID NO: 7456)   Cys Glu Trp Cys Phe Asn Pro Ala Cys Gly Gly Cys
(SEQ ID NO: 7457)   Cys Glu Trp Cys Phe Asn Pro Ala Cys Gly Ala Cys
(SEQ ID NO: 7458)   Cys Glu Trp Cys Phe Asn Pro Thr Cys Thr Gly Cys
(SEQ ID NO: 7459)   Cys Glu Trp Cys Phe Asn Pro Thr Cys Thr Ala Cys
(SEQ ID NO: 7460)   Cys Glu Trp Cys Phe Asn Pro Thr Cys Val Gly Cys
(SEQ ID NO: 7461)   Cys Glu Trp Cys Phe Asn Pro Thr Cys Val Ala Cys
(SEQ ID NO: 7462)   Cys Glu Trp Cys Phe Asn Pro Thr Cys Gly Gly Cys
(SEQ ID NO: 7463)   Cys Glu Trp Cys Phe Asn Pro Thr Cys Gly Ala Cys
(SEQ ID NO: 7464)   Cys Glu Trp Cys Phe Asn Gly Ala Cys Thr Gly Cys
(SEQ ID NO: 7465)   Cys Glu Trp Cys Phe Asn Gly Ala Cys Thr Ala Cys
(SEQ ID NO: 7466)   Cys Glu Trp Cys Phe Asn Gly Ala Cys Val Gly Cys
(SEQ ID NO: 7467)   Cys Glu Trp Cys Phe Asn Gly Ala Cys Val Ala Cys
(SEQ ID NO: 7468)   Cys Glu Trp Cys Phe Asn Gly Ala Cys Gly Gly Cys
(SEQ ID NO: 7469)   Cys Glu Trp Cys Phe Asn Gly Ala Cys Gly Ala Cys
(SEQ ID NO: 7470)   Cys Glu Trp Cys Phe Asn Gly Thr Cys Thr Gly Cys
(SEQ ID NO: 7471)   Cys Glu Trp Cys Phe Asn Gly Thr Cys Thr Ala Cys
(SEQ ID NO: 7472)   Cys Glu Trp Cys Phe Asn Gly Thr Cys Val Gly Cys

FIG. 3

(SEQ ID NO: 7473)  Cys Glu Trp Cys Phe Asn Gly Thr Cys Val Ala Cys
(SEQ ID NO: 7474)  Cys Glu Trp Cys Phe Asn Gly Thr Cys Gly Gly Cys
(SEQ ID NO: 7475)  Cys Glu Trp Cys Phe Asn Gly Thr Cys Gly Ala Cys
(SEQ ID NO: 7476)  Cys Glu Trp Cys Pro Asn Pro Ala Cys Thr Gly Cys
(SEQ ID NO: 7477)  Cys Glu Trp Cys Pro Asn Pro Ala Cys Thr Ala Cys
(SEQ ID NO: 7478)  Cys Glu Trp Cys Pro Asn Pro Ala Cys Val Gly Cys
(SEQ ID NO: 7479)  Cys Glu Trp Cys Pro Asn Pro Ala Cys Val Ala Cys
(SEQ ID NO: 7480)  Cys Glu Trp Cys Pro Asn Pro Ala Cys Gly Gly Cys
(SEQ ID NO: 7481)  Cys Glu Trp Cys Pro Asn Pro Ala Cys Gly Ala Cys
(SEQ ID NO: 7482)  Cys Glu Trp Cys Pro Asn Pro Thr Cys Thr Gly Cys
(SEQ ID NO: 7483)  Cys Glu Trp Cys Pro Asn Pro Thr Cys Thr Ala Cys
(SEQ ID NO: 7484)  Cys Glu Trp Cys Pro Asn Pro Thr Cys Val Gly Cys
(SEQ ID NO: 7485)  Cys Glu Trp Cys Pro Asn Pro Thr Cys Val Ala Cys
(SEQ ID NO: 7486)  Cys Glu Trp Cys Pro Asn Pro Thr Cys Gly Gly Cys
(SEQ ID NO: 7487)  Cys Glu Trp Cys Pro Asn Pro Thr Cys Gly Ala Cys
(SEQ ID NO: 7488)  Cys Glu Trp Cys Pro Asn Gly Ala Cys Thr Gly Cys
(SEQ ID NO: 7489)  Cys Glu Trp Cys Pro Asn Gly Ala Cys Thr Ala Cys
(SEQ ID NO: 7490)  Cys Glu Trp Cys Pro Asn Gly Ala Cys Val Gly Cys
(SEQ ID NO: 7491)  Cys Glu Trp Cys Pro Asn Gly Ala Cys Val Ala Cys
(SEQ ID NO: 7492)  Cys Glu Trp Cys Pro Asn Gly Ala Cys Gly Gly Cys
(SEQ ID NO: 7493)  Cys Glu Trp Cys Pro Asn Gly Ala Cys Gly Ala Cys
(SEQ ID NO: 7494)  Cys Glu Trp Cys Pro Asn Gly Thr Cys Thr Gly Cys
(SEQ ID NO: 7495)  Cys Glu Trp Cys Pro Asn Gly Thr Cys Thr Ala Cys
(SEQ ID NO: 7496)  Cys Glu Trp Cys Pro Asn Gly Thr Cys Val Gly Cys
(SEQ ID NO: 7497)  Cys Glu Trp Cys Pro Asn Gly Thr Cys Val Ala Cys
(SEQ ID NO: 7498)  Cys Glu Trp Cys Pro Asn Gly Thr Cys Gly Gly Cys
(SEQ ID NO: 7499)  Cys Glu Trp Cys Pro Asn Gly Thr Cys Gly Ala Cys
(SEQ ID NO: 7500)  Cys Glu Trp Cys Ser Asn Pro Ala Cys Thr Gly Cys
(SEQ ID NO: 7501)  Cys Glu Trp Cys Ser Asn Pro Ala Cys Thr Ala Cys
(SEQ ID NO: 7502)  Cys Glu Trp Cys Ser Asn Pro Ala Cys Val Gly Cys
(SEQ ID NO: 7503)  Cys Glu Trp Cys Ser Asn Pro Ala Cys Val Ala Cys
(SEQ ID NO: 7504)  Cys Glu Trp Cys Ser Asn Pro Ala Cys Gly Gly Cys
(SEQ ID NO: 7505)  Cys Glu Trp Cys Ser Asn Pro Ala Cys Gly Ala Cys
(SEQ ID NO: 7506)  Cys Glu Trp Cys Ser Asn Pro Thr Cys Thr Gly Cys
(SEQ ID NO: 7507)  Cys Glu Trp Cys Ser Asn Pro Thr Cys Thr Ala Cys
(SEQ ID NO: 7508)  Cys Glu Trp Cys Ser Asn Pro Thr Cys Val Gly Cys
(SEQ ID NO: 7509)  Cys Glu Trp Cys Ser Asn Pro Thr Cys Val Ala Cys
(SEQ ID NO: 7510)  Cys Glu Trp Cys Ser Asn Pro Thr Cys Gly Gly Cys
(SEQ ID NO: 7511)  Cys Glu Trp Cys Ser Asn Pro Thr Cys Gly Ala Cys
(SEQ ID NO: 7512)  Cys Glu Trp Cys Ser Asn Gly Ala Cys Thr Gly Cys
(SEQ ID NO: 7513)  Cys Glu Trp Cys Ser Asn Gly Ala Cys Thr Ala Cys
(SEQ ID NO: 7514)  Cys Glu Trp Cys Ser Asn Gly Ala Cys Val Gly Cys
(SEQ ID NO: 7515)  Cys Glu Trp Cys Ser Asn Gly Ala Cys Val Ala Cys

FIG. 3

(SEQ ID NO: 7516) Cys Glu Trp Cys Ser Asn Gly Ala Cys Gly Gly Cys
(SEQ ID NO: 7517) Cys Glu Trp Cys Ser Asn Gly Ala Cys Gly Ala Cys
(SEQ ID NO: 7518) Cys Glu Trp Cys Ser Asn Gly Thr Cys Thr Gly Cys
(SEQ ID NO: 7519) Cys Glu Trp Cys Ser Asn Gly Thr Cys Thr Ala Cys
(SEQ ID NO: 7520) Cys Glu Trp Cys Ser Asn Gly Thr Cys Val Gly Cys
(SEQ ID NO: 7521) Cys Glu Trp Cys Ser Asn Gly Thr Cys Val Ala Cys
(SEQ ID NO: 7522) Cys Glu Trp Cys Ser Asn Gly Thr Cys Gly Gly Cys
(SEQ ID NO: 7523) Cys Glu Trp Cys Ser Asn Gly Thr Cys Gly Ala Cys
(SEQ ID NO: 7524) Cys Glu Trp Cys Thr Asn Pro Ala Cys Thr Gly Cys
(SEQ ID NO: 7525) Cys Glu Trp Cys Thr Asn Pro Ala Cys Thr Ala Cys
(SEQ ID NO: 7526) Cys Glu Trp Cys Thr Asn Pro Ala Cys Val Gly Cys
(SEQ ID NO: 7527) Cys Glu Trp Cys Thr Asn Pro Ala Cys Val Ala Cys
(SEQ ID NO: 7528) Cys Glu Trp Cys Thr Asn Pro Ala Cys Gly Gly Cys
(SEQ ID NO: 7529) Cys Glu Trp Cys Thr Asn Pro Ala Cys Gly Ala Cys
(SEQ ID NO: 7530) Cys Glu Trp Cys Thr Asn Pro Thr Cys Thr Gly Cys
(SEQ ID NO: 7531) Cys Glu Trp Cys Thr Asn Pro Thr Cys Thr Ala Cys
(SEQ ID NO: 7532) Cys Glu Trp Cys Thr Asn Pro Thr Cys Val Gly Cys
(SEQ ID NO: 7533) Cys Glu Trp Cys Thr Asn Pro Thr Cys Val Ala Cys
(SEQ ID NO: 7534) Cys Glu Trp Cys Thr Asn Pro Thr Cys Gly Gly Cys
(SEQ ID NO: 7535) Cys Glu Trp Cys Thr Asn Pro Thr Cys Gly Ala Cys
(SEQ ID NO: 7536) Cys Glu Trp Cys Thr Asn Gly Ala Cys Thr Gly Cys
(SEQ ID NO: 7537) Cys Glu Trp Cys Thr Asn Gly Ala Cys Thr Ala Cys
(SEQ ID NO: 7538) Cys Glu Trp Cys Thr Asn Gly Ala Cys Val Gly Cys
(SEQ ID NO: 7539) Cys Glu Trp Cys Thr Asn Gly Ala Cys Val Ala Cys
(SEQ ID NO: 7540) Cys Glu Trp Cys Thr Asn Gly Ala Cys Gly Gly Cys
(SEQ ID NO: 7541) Cys Glu Trp Cys Thr Asn Gly Ala Cys Gly Ala Cys
(SEQ ID NO: 7542) Cys Glu Trp Cys Thr Asn Gly Thr Cys Thr Gly Cys
(SEQ ID NO: 7543) Cys Glu Trp Cys Thr Asn Gly Thr Cys Thr Ala Cys
(SEQ ID NO: 7544) Cys Glu Trp Cys Thr Asn Gly Thr Cys Val Gly Cys
(SEQ ID NO: 7545) Cys Glu Trp Cys Thr Asn Gly Thr Cys Val Ala Cys
(SEQ ID NO: 7546) Cys Glu Trp Cys Thr Asn Gly Thr Cys Gly Gly Cys
(SEQ ID NO: 7547) Cys Glu Trp Cys Thr Asn Gly Thr Cys Gly Ala Cys
(SEQ ID NO: 7548) Cys Glu Trp Cys Trp Asn Pro Ala Cys Thr Gly Cys
(SEQ ID NO: 7549) Cys Glu Trp Cys Trp Asn Pro Ala Cys Thr Ala Cys
(SEQ ID NO: 7550) Cys Glu Trp Cys Trp Asn Pro Ala Cys Val Gly Cys
(SEQ ID NO: 7551) Cys Glu Trp Cys Trp Asn Pro Ala Cys Val Ala Cys
(SEQ ID NO: 7552) Cys Glu Trp Cys Trp Asn Pro Ala Cys Gly Gly Cys
(SEQ ID NO: 7553) Cys Glu Trp Cys Trp Asn Pro Ala Cys Gly Ala Cys
(SEQ ID NO: 7554) Cys Glu Trp Cys Trp Asn Pro Thr Cys Thr Gly Cys
(SEQ ID NO: 7555) Cys Glu Trp Cys Trp Asn Pro Thr Cys Thr Ala Cys
(SEQ ID NO: 7556) Cys Glu Trp Cys Trp Asn Pro Thr Cys Val Gly Cys
(SEQ ID NO: 7557) Cys Glu Trp Cys Trp Asn Pro Thr Cys Val Ala Cys
(SEQ ID NO: 7558) Cys Glu Trp Cys Trp Asn Pro Thr Cys Gly Gly Cys

FIG. 3

| | |
|---|---|
| (SEQ ID NO: 7559 ) | Cys Glu Trp Cys Trp Asn Pro Thr Cys Gly Ala Cys |
| (SEQ ID NO: 7560 ) | Cys Glu Trp Cys Trp Asn Gly Ala Cys Thr Gly Cys |
| (SEQ ID NO: 7561 ) | Cys Glu Trp Cys Trp Asn Gly Ala Cys Thr Ala Cys |
| (SEQ ID NO: 7562 ) | Cys Glu Trp Cys Trp Asn Gly Ala Cys Val Gly Cys |
| (SEQ ID NO: 7563 ) | Cys Glu Trp Cys Trp Asn Gly Ala Cys Val Ala Cys |
| (SEQ ID NO: 7564 ) | Cys Glu Trp Cys Trp Asn Gly Ala Cys Gly Gly Cys |
| (SEQ ID NO: 7565 ) | Cys Glu Trp Cys Trp Asn Gly Ala Cys Gly Ala Cys |
| (SEQ ID NO: 7566 ) | Cys Glu Trp Cys Trp Asn Gly Thr Cys Thr Gly Cys |
| (SEQ ID NO: 7567 ) | Cys Glu Trp Cys Trp Asn Gly Thr Cys Thr Ala Cys |
| (SEQ ID NO: 7568 ) | Cys Glu Trp Cys Trp Asn Gly Thr Cys Val Gly Cys |
| (SEQ ID NO: 7569 ) | Cys Glu Trp Cys Trp Asn Gly Thr Cys Val Ala Cys |
| (SEQ ID NO: 7570 ) | Cys Glu Trp Cys Trp Asn Gly Thr Cys Gly Gly Cys |
| (SEQ ID NO: 7571 ) | Cys Glu Trp Cys Trp Asn Gly Thr Cys Gly Ala Cys |
| (SEQ ID NO: 7572 ) | Cys Glu Trp Cys Tyr Asn Pro Ala Cys Thr Gly Cys |
| (SEQ ID NO: 7573 ) | Cys Glu Trp Cys Tyr Asn Pro Ala Cys Thr Ala Cys |
| (SEQ ID NO: 7574 ) | Cys Glu Trp Cys Tyr Asn Pro Ala Cys Val Gly Cys |
| (SEQ ID NO: 7575 ) | Cys Glu Trp Cys Tyr Asn Pro Ala Cys Val Ala Cys |
| (SEQ ID NO: 7576 ) | Cys Glu Trp Cys Tyr Asn Pro Ala Cys Gly Gly Cys |
| (SEQ ID NO: 7577 ) | Cys Glu Trp Cys Tyr Asn Pro Ala Cys Gly Ala Cys |
| (SEQ ID NO: 7578 ) | Cys Glu Trp Cys Tyr Asn Pro Thr Cys Thr Gly Cys |
| (SEQ ID NO: 7579 ) | Cys Glu Trp Cys Tyr Asn Pro Thr Cys Thr Ala Cys |
| (SEQ ID NO: 7580 ) | Cys Glu Trp Cys Tyr Asn Pro Thr Cys Val Gly Cys |
| (SEQ ID NO: 7581 ) | Cys Glu Trp Cys Tyr Asn Pro Thr Cys Val Ala Cys |
| (SEQ ID NO: 7582 ) | Cys Glu Trp Cys Tyr Asn Pro Thr Cys Gly Gly Cys |
| (SEQ ID NO: 7583 ) | Cys Glu Trp Cys Tyr Asn Pro Thr Cys Gly Ala Cys |
| (SEQ ID NO: 7584 ) | Cys Glu Trp Cys Tyr Asn Gly Ala Cys Thr Gly Cys |
| (SEQ ID NO: 7585 ) | Cys Glu Trp Cys Tyr Asn Gly Ala Cys Thr Ala Cys |
| (SEQ ID NO: 7586 ) | Cys Glu Trp Cys Tyr Asn Gly Ala Cys Val Gly Cys |
| (SEQ ID NO: 7587 ) | Cys Glu Trp Cys Tyr Asn Gly Ala Cys Val Ala Cys |
| (SEQ ID NO: 7588 ) | Cys Glu Trp Cys Tyr Asn Gly Ala Cys Gly Gly Cys |
| (SEQ ID NO: 7589 ) | Cys Glu Trp Cys Tyr Asn Gly Ala Cys Gly Ala Cys |
| (SEQ ID NO: 7590 ) | Cys Glu Trp Cys Tyr Asn Gly Thr Cys Thr Gly Cys |
| (SEQ ID NO: 7591 ) | Cys Glu Trp Cys Tyr Asn Gly Thr Cys Thr Ala Cys |
| (SEQ ID NO: 7592 ) | Cys Glu Trp Cys Tyr Asn Gly Thr Cys Val Gly Cys |
| (SEQ ID NO: 7593 ) | Cys Glu Trp Cys Tyr Asn Gly Thr Cys Val Ala Cys |
| (SEQ ID NO: 7594 ) | Cys Glu Trp Cys Tyr Asn Gly Thr Cys Gly Gly Cys |
| (SEQ ID NO: 7595 ) | Cys Glu Trp Cys Tyr Asn Gly Thr Cys Gly Ala Cys |
| (SEQ ID NO: 7596 ) | Cys Glu Trp Cys Val Asn Pro Ala Cys Thr Gly Cys |
| (SEQ ID NO: 7597 ) | Cys Glu Trp Cys Val Asn Pro Ala Cys Thr Ala Cys |
| (SEQ ID NO: 7598 ) | Cys Glu Trp Cys Val Asn Pro Ala Cys Val Gly Cys |
| (SEQ ID NO: 7599 ) | Cys Glu Trp Cys Val Asn Pro Ala Cys Val Ala Cys |
| (SEQ ID NO: 7600 ) | Cys Glu Trp Cys Val Asn Pro Ala Cys Gly Gly Cys |
| (SEQ ID NO: 7601 ) | Cys Glu Trp Cys Val Asn Pro Ala Cys Gly Ala Cys |

FIG. 3

| | |
|---|---|
| (SEQ ID NO: 7602) | Cys Glu Trp Cys Val Asn Pro Thr Cys Thr Gly Cys |
| (SEQ ID NO: 7603) | Cys Glu Trp Cys Val Asn Pro Thr Cys Thr Ala Cys |
| (SEQ ID NO: 7604) | Cys Glu Trp Cys Val Asn Pro Thr Cys Val Gly Cys |
| (SEQ ID NO: 7605) | Cys Glu Trp Cys Val Asn Pro Thr Cys Val Ala Cys |
| (SEQ ID NO: 7606) | Cys Glu Trp Cys Val Asn Pro Thr Cys Gly Gly Cys |
| (SEQ ID NO: 7607) | Cys Glu Trp Cys Val Asn Pro Thr Cys Gly Ala Cys |
| (SEQ ID NO: 7608) | Cys Glu Trp Cys Val Asn Gly Ala Cys Thr Gly Cys |
| (SEQ ID NO: 7609) | Cys Glu Trp Cys Val Asn Gly Ala Cys Thr Ala Cys |
| (SEQ ID NO: 7610) | Cys Glu Trp Cys Val Asn Gly Ala Cys Val Gly Cys |
| (SEQ ID NO: 7611) | Cys Glu Trp Cys Val Asn Gly Ala Cys Val Ala Cys |
| (SEQ ID NO: 7612) | Cys Glu Trp Cys Val Asn Gly Ala Cys Gly Gly Cys |
| (SEQ ID NO: 7613) | Cys Glu Trp Cys Val Asn Gly Ala Cys Gly Ala Cys |
| (SEQ ID NO: 7614) | Cys Glu Trp Cys Val Asn Gly Thr Cys Thr Gly Cys |
| (SEQ ID NO: 7615) | Cys Glu Trp Cys Val Asn Gly Thr Cys Thr Ala Cys |
| (SEQ ID NO: 7616) | Cys Glu Trp Cys Val Asn Gly Thr Cys Val Gly Cys |
| (SEQ ID NO: 7617) | Cys Glu Trp Cys Val Asn Gly Thr Cys Val Ala Cys |
| (SEQ ID NO: 7618) | Cys Glu Trp Cys Val Asn Gly Thr Cys Gly Gly Cys |
| (SEQ ID NO: 7619) | Cys Glu Trp Cys Val Asn Gly Thr Cys Gly Ala Cys |
| (SEQ ID NO: 7620) | Cys Glu Trp Cys --- Asn Pro Ala Cys Thr Gly Cys |
| (SEQ ID NO: 7621) | Cys Glu Trp Cys --- Asn Pro Ala Cys Thr Ala Cys |
| (SEQ ID NO: 7622) | Cys Glu Trp Cys --- Asn Pro Ala Cys Val Gly Cys |
| (SEQ ID NO: 7623) | Cys Glu Trp Cys --- Asn Pro Ala Cys Val Ala Cys |
| (SEQ ID NO: 7624) | Cys Glu Trp Cys --- Asn Pro Ala Cys Gly Gly Cys |
| (SEQ ID NO: 7625) | Cys Glu Trp Cys --- Asn Pro Ala Cys Gly Ala Cys |
| (SEQ ID NO: 7626) | Cys Glu Trp Cys --- Asn Pro Thr Cys Thr Gly Cys |
| (SEQ ID NO: 7627) | Cys Glu Trp Cys --- Asn Pro Thr Cys Thr Ala Cys |
| (SEQ ID NO: 7628) | Cys Glu Trp Cys --- Asn Pro Thr Cys Val Gly Cys |
| (SEQ ID NO: 7629) | Cys Glu Trp Cys --- Asn Pro Thr Cys Val Ala Cys |
| (SEQ ID NO: 7630) | Cys Glu Trp Cys --- Asn Pro Thr Cys Gly Gly Cys |
| (SEQ ID NO: 7631) | Cys Glu Trp Cys --- Asn Pro Thr Cys Gly Ala Cys |
| (SEQ ID NO: 7632) | Cys Glu Trp Cys --- Asn Gly Ala Cys Thr Gly Cys |
| (SEQ ID NO: 7633) | Cys Glu Trp Cys --- Asn Gly Ala Cys Thr Ala Cys |
| (SEQ ID NO: 7634) | Cys Glu Trp Cys --- Asn Gly Ala Cys Val Gly Cys |
| (SEQ ID NO: 7635) | Cys Glu Trp Cys --- Asn Gly Ala Cys Val Ala Cys |
| (SEQ ID NO: 7636) | Cys Glu Trp Cys --- Asn Gly Ala Cys Gly Gly Cys |
| (SEQ ID NO: 7637) | Cys Glu Trp Cys --- Asn Gly Ala Cys Gly Ala Cys |
| (SEQ ID NO: 7638) | Cys Glu Trp Cys --- Asn Gly Thr Cys Thr Gly Cys |
| (SEQ ID NO: 7639) | Cys Glu Trp Cys --- Asn Gly Thr Cys Thr Ala Cys |
| (SEQ ID NO: 7640) | Cys Glu Trp Cys --- Asn Gly Thr Cys Val Gly Cys |
| (SEQ ID NO: 7641) | Cys Glu Trp Cys --- Asn Gly Thr Cys Val Ala Cys |
| (SEQ ID NO: 7642) | Cys Glu Trp Cys --- Asn Gly Thr Cys Gly Gly Cys |
| (SEQ ID NO: 7643) | Cys Glu Trp Cys --- Asn Gly Thr Cys Gly Ala Cys |
| (SEQ ID NO: 7644) | Cys Glu Phe Cys Ala Asn Pro Ala Cys Thr Gly Cys |

FIG. 3

| | |
|---|---|
| (SEQ ID NO: 7645) | Cys Glu Phe Cys Ala Asn Pro Ala Cys Thr Ala Cys |
| (SEQ ID NO: 7646) | Cys Glu Phe Cys Ala Asn Pro Ala Cys Val Gly Cys |
| (SEQ ID NO: 7647) | Cys Glu Phe Cys Ala Asn Pro Ala Cys Val Ala Cys |
| (SEQ ID NO: 7648) | Cys Glu Phe Cys Ala Asn Pro Ala Cys Gly Gly Cys |
| (SEQ ID NO: 7649) | Cys Glu Phe Cys Ala Asn Pro Ala Cys Gly Ala Cys |
| (SEQ ID NO: 7650) | Cys Glu Phe Cys Ala Asn Pro Thr Cys Thr Gly Cys |
| (SEQ ID NO: 7651) | Cys Glu Phe Cys Ala Asn Pro Thr Cys Thr Ala Cys |
| (SEQ ID NO: 7652) | Cys Glu Phe Cys Ala Asn Pro Thr Cys Val Gly Cys |
| (SEQ ID NO: 7653) | Cys Glu Phe Cys Ala Asn Pro Thr Cys Val Ala Cys |
| (SEQ ID NO: 7654) | Cys Glu Phe Cys Ala Asn Pro Thr Cys Gly Gly Cys |
| (SEQ ID NO: 7655) | Cys Glu Phe Cys Ala Asn Pro Thr Cys Gly Ala Cys |
| (SEQ ID NO: 7656) | Cys Glu Phe Cys Ala Asn Gly Ala Cys Thr Gly Cys |
| (SEQ ID NO: 7657) | Cys Glu Phe Cys Ala Asn Gly Ala Cys Thr Ala Cys |
| (SEQ ID NO: 7658) | Cys Glu Phe Cys Ala Asn Gly Ala Cys Val Gly Cys |
| (SEQ ID NO: 7659) | Cys Glu Phe Cys Ala Asn Gly Ala Cys Val Ala Cys |
| (SEQ ID NO: 7660) | Cys Glu Phe Cys Ala Asn Gly Ala Cys Gly Gly Cys |
| (SEQ ID NO: 7661) | Cys Glu Phe Cys Ala Asn Gly Ala Cys Gly Ala Cys |
| (SEQ ID NO: 7662) | Cys Glu Phe Cys Ala Asn Gly Thr Cys Thr Gly Cys |
| (SEQ ID NO: 7663) | Cys Glu Phe Cys Ala Asn Gly Thr Cys Thr Ala Cys |
| (SEQ ID NO: 7664) | Cys Glu Phe Cys Ala Asn Gly Thr Cys Val Gly Cys |
| (SEQ ID NO: 7665) | Cys Glu Phe Cys Ala Asn Gly Thr Cys Val Ala Cys |
| (SEQ ID NO: 7666) | Cys Glu Phe Cys Ala Asn Gly Thr Cys Gly Gly Cys |
| (SEQ ID NO: 7667) | Cys Glu Phe Cys Ala Asn Gly Thr Cys Gly Ala Cys |
| (SEQ ID NO: 7668) | Cys Glu Phe Cys Arg Asn Pro Ala Cys Thr Gly Cys |
| (SEQ ID NO: 7669) | Cys Glu Phe Cys Arg Asn Pro Ala Cys Thr Ala Cys |
| (SEQ ID NO: 7670) | Cys Glu Phe Cys Arg Asn Pro Ala Cys Val Gly Cys |
| (SEQ ID NO: 7671) | Cys Glu Phe Cys Arg Asn Pro Ala Cys Val Ala Cys |
| (SEQ ID NO: 7672) | Cys Glu Phe Cys Arg Asn Pro Ala Cys Gly Gly Cys |
| (SEQ ID NO: 7673) | Cys Glu Phe Cys Arg Asn Pro Ala Cys Gly Ala Cys |
| (SEQ ID NO: 7674) | Cys Glu Phe Cys Arg Asn Pro Thr Cys Thr Gly Cys |
| (SEQ ID NO: 7675) | Cys Glu Phe Cys Arg Asn Pro Thr Cys Thr Ala Cys |
| (SEQ ID NO: 7676) | Cys Glu Phe Cys Arg Asn Pro Thr Cys Val Gly Cys |
| (SEQ ID NO: 7677) | Cys Glu Phe Cys Arg Asn Pro Thr Cys Val Ala Cys |
| (SEQ ID NO: 7678) | Cys Glu Phe Cys Arg Asn Pro Thr Cys Gly Gly Cys |
| (SEQ ID NO: 7679) | Cys Glu Phe Cys Arg Asn Pro Thr Cys Gly Ala Cys |
| (SEQ ID NO: 7680) | Cys Glu Phe Cys Arg Asn Gly Ala Cys Thr Gly Cys |
| (SEQ ID NO: 7681) | Cys Glu Phe Cys Arg Asn Gly Ala Cys Thr Ala Cys |
| (SEQ ID NO: 7682) | Cys Glu Phe Cys Arg Asn Gly Ala Cys Val Gly Cys |
| (SEQ ID NO: 7683) | Cys Glu Phe Cys Arg Asn Gly Ala Cys Val Ala Cys |
| (SEQ ID NO: 7684) | Cys Glu Phe Cys Arg Asn Gly Ala Cys Gly Gly Cys |
| (SEQ ID NO: 7685) | Cys Glu Phe Cys Arg Asn Gly Ala Cys Gly Ala Cys |
| (SEQ ID NO: 7686) | Cys Glu Phe Cys Arg Asn Gly Thr Cys Thr Gly Cys |
| (SEQ ID NO: 7687) | Cys Glu Phe Cys Arg Asn Gly Thr Cys Thr Ala Cys |

FIG. 3

| | |
|---|---|
| (SEQ ID NO: 7688) | Cys Glu Phe Cys Arg Asn Gly Thr Cys Val Gly Cys |
| (SEQ ID NO: 7689) | Cys Glu Phe Cys Arg Asn Gly Thr Cys Val Ala Cys |
| (SEQ ID NO: 7690) | Cys Glu Phe Cys Arg Asn Gly Thr Cys Gly Gly Cys |
| (SEQ ID NO: 7691) | Cys Glu Phe Cys Arg Asn Gly Thr Cys Gly Ala Cys |
| (SEQ ID NO: 7692) | Cys Glu Phe Cys Asn Asn Pro Ala Cys Thr Gly Cys |
| (SEQ ID NO: 7693) | Cys Glu Phe Cys Asn Asn Pro Ala Cys Thr Ala Cys |
| (SEQ ID NO: 7694) | Cys Glu Phe Cys Asn Asn Pro Ala Cys Val Gly Cys |
| (SEQ ID NO: 7695) | Cys Glu Phe Cys Asn Asn Pro Ala Cys Val Ala Cys |
| (SEQ ID NO: 7696) | Cys Glu Phe Cys Asn Asn Pro Ala Cys Gly Gly Cys |
| (SEQ ID NO: 7697) | Cys Glu Phe Cys Asn Asn Pro Ala Cys Gly Ala Cys |
| (SEQ ID NO: 7698) | Cys Glu Phe Cys Asn Asn Pro Thr Cys Thr Gly Cys |
| (SEQ ID NO: 7699) | Cys Glu Phe Cys Asn Asn Pro Thr Cys Thr Ala Cys |
| (SEQ ID NO: 7700) | Cys Glu Phe Cys Asn Asn Pro Thr Cys Val Gly Cys |
| (SEQ ID NO: 7701) | Cys Glu Phe Cys Asn Asn Pro Thr Cys Val Ala Cys |
| (SEQ ID NO: 7702) | Cys Glu Phe Cys Asn Asn Pro Thr Cys Gly Gly Cys |
| (SEQ ID NO: 7703) | Cys Glu Phe Cys Asn Asn Pro Thr Cys Gly Ala Cys |
| (SEQ ID NO: 7704) | Cys Glu Phe Cys Asn Asn Gly Ala Cys Thr Gly Cys |
| (SEQ ID NO: 7705) | Cys Glu Phe Cys Asn Asn Gly Ala Cys Thr Ala Cys |
| (SEQ ID NO: 7706) | Cys Glu Phe Cys Asn Asn Gly Ala Cys Val Gly Cys |
| (SEQ ID NO: 7707) | Cys Glu Phe Cys Asn Asn Gly Ala Cys Val Ala Cys |
| (SEQ ID NO: 7708) | Cys Glu Phe Cys Asn Asn Gly Ala Cys Gly Gly Cys |
| (SEQ ID NO: 7709) | Cys Glu Phe Cys Asn Asn Gly Ala Cys Gly Ala Cys |
| (SEQ ID NO: 7710) | Cys Glu Phe Cys Asn Asn Gly Thr Cys Thr Gly Cys |
| (SEQ ID NO: 7711) | Cys Glu Phe Cys Asn Asn Gly Thr Cys Thr Ala Cys |
| (SEQ ID NO: 7712) | Cys Glu Phe Cys Asn Asn Gly Thr Cys Val Gly Cys |
| (SEQ ID NO: 7713) | Cys Glu Phe Cys Asn Asn Gly Thr Cys Val Ala Cys |
| (SEQ ID NO: 7714) | Cys Glu Phe Cys Asn Asn Gly Thr Cys Gly Gly Cys |
| (SEQ ID NO: 7715) | Cys Glu Phe Cys Asn Asn Gly Thr Cys Gly Ala Cys |
| (SEQ ID NO: 7716) | Cys Glu Phe Cys Asp Asn Pro Ala Cys Thr Gly Cys |
| (SEQ ID NO: 7717) | Cys Glu Phe Cys Asp Asn Pro Ala Cys Thr Ala Cys |
| (SEQ ID NO: 7718) | Cys Glu Phe Cys Asp Asn Pro Ala Cys Val Gly Cys |
| (SEQ ID NO: 7719) | Cys Glu Phe Cys Asp Asn Pro Ala Cys Val Ala Cys |
| (SEQ ID NO: 7720) | Cys Glu Phe Cys Asp Asn Pro Ala Cys Gly Gly Cys |
| (SEQ ID NO: 7721) | Cys Glu Phe Cys Asp Asn Pro Ala Cys Gly Ala Cys |
| (SEQ ID NO: 7722) | Cys Glu Phe Cys Asp Asn Pro Thr Cys Thr Gly Cys |
| (SEQ ID NO: 7723) | Cys Glu Phe Cys Asp Asn Pro Thr Cys Thr Ala Cys |
| (SEQ ID NO: 7724) | Cys Glu Phe Cys Asp Asn Pro Thr Cys Val Gly Cys |
| (SEQ ID NO: 7725) | Cys Glu Phe Cys Asp Asn Pro Thr Cys Val Ala Cys |
| (SEQ ID NO: 7726) | Cys Glu Phe Cys Asp Asn Pro Thr Cys Gly Gly Cys |
| (SEQ ID NO: 7727) | Cys Glu Phe Cys Asp Asn Pro Thr Cys Gly Ala Cys |
| (SEQ ID NO: 7728) | Cys Glu Phe Cys Asp Asn Gly Ala Cys Thr Gly Cys |
| (SEQ ID NO: 7729) | Cys Glu Phe Cys Asp Asn Gly Ala Cys Thr Ala Cys |
| (SEQ ID NO: 7730) | Cys Glu Phe Cys Asp Asn Gly Ala Cys Val Gly Cys |

FIG. 3

(SEQ ID NO: 7731) Cys Glu Phe Cys Asp Asn Gly Ala Cys Val Ala Cys
(SEQ ID NO: 7732) Cys Glu Phe Cys Asp Asn Gly Ala Cys Gly Gly Cys
(SEQ ID NO: 7733) Cys Glu Phe Cys Asp Asn Gly Ala Cys Gly Ala Cys
(SEQ ID NO: 7734) Cys Glu Phe Cys Asp Asn Gly Thr Cys Thr Gly Cys
(SEQ ID NO: 7735) Cys Glu Phe Cys Asp Asn Gly Thr Cys Thr Ala Cys
(SEQ ID NO: 7736) Cys Glu Phe Cys Asp Asn Gly Thr Cys Val Gly Cys
(SEQ ID NO: 7737) Cys Glu Phe Cys Asp Asn Gly Thr Cys Val Ala Cys
(SEQ ID NO: 7738) Cys Glu Phe Cys Asp Asn Gly Thr Cys Gly Gly Cys
(SEQ ID NO: 7739) Cys Glu Phe Cys Asp Asn Gly Thr Cys Gly Ala Cys
(SEQ ID NO: 7740) Cys Glu Phe Cys Gln Asn Pro Ala Cys Thr Gly Cys
(SEQ ID NO: 7741) Cys Glu Phe Cys Gln Asn Pro Ala Cys Thr Ala Cys
(SEQ ID NO: 7742) Cys Glu Phe Cys Gln Asn Pro Ala Cys Val Gly Cys
(SEQ ID NO: 7743) Cys Glu Phe Cys Gln Asn Pro Ala Cys Val Ala Cys
(SEQ ID NO: 7744) Cys Glu Phe Cys Gln Asn Pro Ala Cys Gly Gly Cys
(SEQ ID NO: 7745) Cys Glu Phe Cys Gln Asn Pro Ala Cys Gly Ala Cys
(SEQ ID NO: 7746) Cys Glu Phe Cys Gln Asn Pro Thr Cys Thr Gly Cys
(SEQ ID NO: 7747) Cys Glu Phe Cys Gln Asn Pro Thr Cys Thr Ala Cys
(SEQ ID NO: 7748) Cys Glu Phe Cys Gln Asn Pro Thr Cys Val Gly Cys
(SEQ ID NO: 7749) Cys Glu Phe Cys Gln Asn Pro Thr Cys Val Ala Cys
(SEQ ID NO: 7750) Cys Glu Phe Cys Gln Asn Pro Thr Cys Gly Gly Cys
(SEQ ID NO: 7751) Cys Glu Phe Cys Gln Asn Pro Thr Cys Gly Ala Cys
(SEQ ID NO: 7752) Cys Glu Phe Cys Gln Asn Gly Ala Cys Thr Gly Cys
(SEQ ID NO: 7753) Cys Glu Phe Cys Gln Asn Gly Ala Cys Thr Ala Cys
(SEQ ID NO: 7754) Cys Glu Phe Cys Gln Asn Gly Ala Cys Val Gly Cys
(SEQ ID NO: 7755) Cys Glu Phe Cys Gln Asn Gly Ala Cys Val Ala Cys
(SEQ ID NO: 7756) Cys Glu Phe Cys Gln Asn Gly Ala Cys Gly Gly Cys
(SEQ ID NO: 7757) Cys Glu Phe Cys Gln Asn Gly Ala Cys Gly Ala Cys
(SEQ ID NO: 7758) Cys Glu Phe Cys Gln Asn Gly Thr Cys Thr Gly Cys
(SEQ ID NO: 7759) Cys Glu Phe Cys Gln Asn Gly Thr Cys Thr Ala Cys
(SEQ ID NO: 7760) Cys Glu Phe Cys Gln Asn Gly Thr Cys Val Gly Cys
(SEQ ID NO: 7761) Cys Glu Phe Cys Gln Asn Gly Thr Cys Val Ala Cys
(SEQ ID NO: 7762) Cys Glu Phe Cys Gln Asn Gly Thr Cys Gly Gly Cys
(SEQ ID NO: 7763) Cys Glu Phe Cys Gln Asn Gly Thr Cys Gly Ala Cys
(SEQ ID NO: 7764) Cys Glu Phe Cys Glu Asn Pro Ala Cys Thr Gly Cys
(SEQ ID NO: 7765) Cys Glu Phe Cys Glu Asn Pro Ala Cys Thr Ala Cys
(SEQ ID NO: 7766) Cys Glu Phe Cys Glu Asn Pro Ala Cys Val Gly Cys
(SEQ ID NO: 7767) Cys Glu Phe Cys Glu Asn Pro Ala Cys Val Ala Cys
(SEQ ID NO: 7768) Cys Glu Phe Cys Glu Asn Pro Ala Cys Gly Gly Cys
(SEQ ID NO: 7769) Cys Glu Phe Cys Glu Asn Pro Ala Cys Gly Ala Cys
(SEQ ID NO: 7770) Cys Glu Phe Cys Glu Asn Pro Thr Cys Thr Gly Cys
(SEQ ID NO: 7771) Cys Glu Phe Cys Glu Asn Pro Thr Cys Thr Ala Cys
(SEQ ID NO: 7772) Cys Glu Phe Cys Glu Asn Pro Thr Cys Val Gly Cys
(SEQ ID NO: 7773) Cys Glu Phe Cys Glu Asn Pro Thr Cys Val Ala Cys

FIG. 3

| | |
|---|---|
| (SEQ ID NO: 7774) | Cys Glu Phe Cys Glu Asn Pro Thr Cys Gly Gly Cys |
| (SEQ ID NO: 7775) | Cys Glu Phe Cys Glu Asn Pro Thr Cys Gly Ala Cys |
| (SEQ ID NO: 7776) | Cys Glu Phe Cys Glu Asn Gly Ala Cys Thr Gly Cys |
| (SEQ ID NO: 7777) | Cys Glu Phe Cys Glu Asn Gly Ala Cys Thr Ala Cys |
| (SEQ ID NO: 7778) | Cys Glu Phe Cys Glu Asn Gly Ala Cys Val Gly Cys |
| (SEQ ID NO: 7779) | Cys Glu Phe Cys Glu Asn Gly Ala Cys Val Ala Cys |
| (SEQ ID NO: 7780) | Cys Glu Phe Cys Glu Asn Gly Ala Cys Gly Gly Cys |
| (SEQ ID NO: 7781) | Cys Glu Phe Cys Glu Asn Gly Ala Cys Gly Ala Cys |
| (SEQ ID NO: 7782) | Cys Glu Phe Cys Glu Asn Gly Thr Cys Thr Gly Cys |
| (SEQ ID NO: 7783) | Cys Glu Phe Cys Glu Asn Gly Thr Cys Thr Ala Cys |
| (SEQ ID NO: 7784) | Cys Glu Phe Cys Glu Asn Gly Thr Cys Val Gly Cys |
| (SEQ ID NO: 7785) | Cys Glu Phe Cys Glu Asn Gly Thr Cys Val Ala Cys |
| (SEQ ID NO: 7786) | Cys Glu Phe Cys Glu Asn Gly Thr Cys Gly Gly Cys |
| (SEQ ID NO: 7787) | Cys Glu Phe Cys Glu Asn Gly Thr Cys Gly Ala Cys |
| (SEQ ID NO: 7788) | Cys Glu Phe Cys Gly Asn Pro Ala Cys Thr Gly Cys |
| (SEQ ID NO: 7789) | Cys Glu Phe Cys Gly Asn Pro Ala Cys Thr Ala Cys |
| (SEQ ID NO: 7790) | Cys Glu Phe Cys Gly Asn Pro Ala Cys Val Gly Cys |
| (SEQ ID NO: 7791) | Cys Glu Phe Cys Gly Asn Pro Ala Cys Val Ala Cys |
| (SEQ ID NO: 7792) | Cys Glu Phe Cys Gly Asn Pro Ala Cys Gly Gly Cys |
| (SEQ ID NO: 7793) | Cys Glu Phe Cys Gly Asn Pro Ala Cys Gly Ala Cys |
| (SEQ ID NO: 7794) | Cys Glu Phe Cys Gly Asn Pro Thr Cys Thr Gly Cys |
| (SEQ ID NO: 7795) | Cys Glu Phe Cys Gly Asn Pro Thr Cys Thr Ala Cys |
| (SEQ ID NO: 7796) | Cys Glu Phe Cys Gly Asn Pro Thr Cys Val Gly Cys |
| (SEQ ID NO: 7797) | Cys Glu Phe Cys Gly Asn Pro Thr Cys Val Ala Cys |
| (SEQ ID NO: 7798) | Cys Glu Phe Cys Gly Asn Pro Thr Cys Gly Gly Cys |
| (SEQ ID NO: 7799) | Cys Glu Phe Cys Gly Asn Pro Thr Cys Gly Ala Cys |
| (SEQ ID NO: 7800) | Cys Glu Phe Cys Gly Asn Gly Ala Cys Thr Gly Cys |
| (SEQ ID NO: 7801) | Cys Glu Phe Cys Gly Asn Gly Ala Cys Thr Ala Cys |
| (SEQ ID NO: 7802) | Cys Glu Phe Cys Gly Asn Gly Ala Cys Val Gly Cys |
| (SEQ ID NO: 7803) | Cys Glu Phe Cys Gly Asn Gly Ala Cys Val Ala Cys |
| (SEQ ID NO: 7804) | Cys Glu Phe Cys Gly Asn Gly Ala Cys Gly Gly Cys |
| (SEQ ID NO: 7805) | Cys Glu Phe Cys Gly Asn Gly Ala Cys Gly Ala Cys |
| (SEQ ID NO: 7806) | Cys Glu Phe Cys Gly Asn Gly Thr Cys Thr Gly Cys |
| (SEQ ID NO: 7807) | Cys Glu Phe Cys Gly Asn Gly Thr Cys Thr Ala Cys |
| (SEQ ID NO: 7808) | Cys Glu Phe Cys Gly Asn Gly Thr Cys Val Gly Cys |
| (SEQ ID NO: 7809) | Cys Glu Phe Cys Gly Asn Gly Thr Cys Val Ala Cys |
| (SEQ ID NO: 7810) | Cys Glu Phe Cys Gly Asn Gly Thr Cys Gly Gly Cys |
| (SEQ ID NO: 7811) | Cys Glu Phe Cys Gly Asn Gly Thr Cys Gly Ala Cys |
| (SEQ ID NO: 7812) | Cys Glu Phe Cys His Asn Pro Ala Cys Thr Gly Cys |
| (SEQ ID NO: 7813) | Cys Glu Phe Cys His Asn Pro Ala Cys Thr Ala Cys |
| (SEQ ID NO: 7814) | Cys Glu Phe Cys His Asn Pro Ala Cys Val Gly Cys |
| (SEQ ID NO: 7815) | Cys Glu Phe Cys His Asn Pro Ala Cys Val Ala Cys |
| (SEQ ID NO: 7816) | Cys Glu Phe Cys His Asn Pro Ala Cys Gly Gly Cys |

FIG. 3

(SEQ ID NO: 7817) Cys Glu Phe Cys His Asn Pro Ala Cys Gly Ala Cys
(SEQ ID NO: 7818) Cys Glu Phe Cys His Asn Pro Thr Cys Thr Gly Cys
(SEQ ID NO: 7819) Cys Glu Phe Cys His Asn Pro Thr Cys Thr Ala Cys
(SEQ ID NO: 7820) Cys Glu Phe Cys His Asn Pro Thr Cys Val Gly Cys
(SEQ ID NO: 7821) Cys Glu Phe Cys His Asn Pro Thr Cys Val Ala Cys
(SEQ ID NO: 7822) Cys Glu Phe Cys His Asn Pro Thr Cys Gly Gly Cys
(SEQ ID NO: 7823) Cys Glu Phe Cys His Asn Pro Thr Cys Gly Ala Cys
(SEQ ID NO: 7824) Cys Glu Phe Cys His Asn Gly Ala Cys Thr Gly Cys
(SEQ ID NO: 7825) Cys Glu Phe Cys His Asn Gly Ala Cys Thr Ala Cys
(SEQ ID NO: 7826) Cys Glu Phe Cys His Asn Gly Ala Cys Val Gly Cys
(SEQ ID NO: 7827) Cys Glu Phe Cys His Asn Gly Ala Cys Val Ala Cys
(SEQ ID NO: 7828) Cys Glu Phe Cys His Asn Gly Ala Cys Gly Gly Cys
(SEQ ID NO: 7829) Cys Glu Phe Cys His Asn Gly Ala Cys Gly Ala Cys
(SEQ ID NO: 7830) Cys Glu Phe Cys His Asn Gly Thr Cys Thr Gly Cys
(SEQ ID NO: 7831) Cys Glu Phe Cys His Asn Gly Thr Cys Thr Ala Cys
(SEQ ID NO: 7832) Cys Glu Phe Cys His Asn Gly Thr Cys Val Gly Cys
(SEQ ID NO: 7833) Cys Glu Phe Cys His Asn Gly Thr Cys Val Ala Cys
(SEQ ID NO: 7834) Cys Glu Phe Cys His Asn Gly Thr Cys Gly Gly Cys
(SEQ ID NO: 7835) Cys Glu Phe Cys His Asn Gly Thr Cys Gly Ala Cys
(SEQ ID NO: 7836) Cys Glu Phe Cys Ile Asn Pro Ala Cys Thr Gly Cys
(SEQ ID NO: 7837) Cys Glu Phe Cys Ile Asn Pro Ala Cys Thr Ala Cys
(SEQ ID NO: 7838) Cys Glu Phe Cys Ile Asn Pro Ala Cys Val Gly Cys
(SEQ ID NO: 7839) Cys Glu Phe Cys Ile Asn Pro Ala Cys Val Ala Cys
(SEQ ID NO: 7840) Cys Glu Phe Cys Ile Asn Pro Ala Cys Gly Gly Cys
(SEQ ID NO: 7841) Cys Glu Phe Cys Ile Asn Pro Ala Cys Gly Ala Cys
(SEQ ID NO: 7842) Cys Glu Phe Cys Ile Asn Pro Thr Cys Thr Gly Cys
(SEQ ID NO: 7843) Cys Glu Phe Cys Ile Asn Pro Thr Cys Thr Ala Cys
(SEQ ID NO: 7844) Cys Glu Phe Cys Ile Asn Pro Thr Cys Val Gly Cys
(SEQ ID NO: 7845) Cys Glu Phe Cys Ile Asn Pro Thr Cys Val Ala Cys
(SEQ ID NO: 7846) Cys Glu Phe Cys Ile Asn Pro Thr Cys Gly Gly Cys
(SEQ ID NO: 7847) Cys Glu Phe Cys Ile Asn Pro Thr Cys Gly Ala Cys
(SEQ ID NO: 7848) Cys Glu Phe Cys Ile Asn Gly Ala Cys Thr Gly Cys
(SEQ ID NO: 7849) Cys Glu Phe Cys Ile Asn Gly Ala Cys Thr Ala Cys
(SEQ ID NO: 7850) Cys Glu Phe Cys Ile Asn Gly Ala Cys Val Gly Cys
(SEQ ID NO: 7851) Cys Glu Phe Cys Ile Asn Gly Ala Cys Val Ala Cys
(SEQ ID NO: 7852) Cys Glu Phe Cys Ile Asn Gly Ala Cys Gly Gly Cys
(SEQ ID NO: 7853) Cys Glu Phe Cys Ile Asn Gly Ala Cys Gly Ala Cys
(SEQ ID NO: 7854) Cys Glu Phe Cys Ile Asn Gly Thr Cys Thr Gly Cys
(SEQ ID NO: 7855) Cys Glu Phe Cys Ile Asn Gly Thr Cys Thr Ala Cys
(SEQ ID NO: 7856) Cys Glu Phe Cys Ile Asn Gly Thr Cys Val Gly Cys
(SEQ ID NO: 7857) Cys Glu Phe Cys Ile Asn Gly Thr Cys Val Ala Cys
(SEQ ID NO: 7858) Cys Glu Phe Cys Ile Asn Gly Thr Cys Gly Gly Cys
(SEQ ID NO: 7859) Cys Glu Phe Cys Ile Asn Gly Thr Cys Gly Ala Cys

FIG. 3

(SEQ ID NO: 7860) Cys Glu Phe Cys Leu Asn Pro Ala Cys Thr Gly Cys
(SEQ ID NO: 7861) Cys Glu Phe Cys Leu Asn Pro Ala Cys Thr Ala Cys
(SEQ ID NO: 7862) Cys Glu Phe Cys Leu Asn Pro Ala Cys Val Gly Cys
(SEQ ID NO: 7863) Cys Glu Phe Cys Leu Asn Pro Ala Cys Val Ala Cys
(SEQ ID NO: 7864) Cys Glu Phe Cys Leu Asn Pro Ala Cys Gly Gly Cys
(SEQ ID NO: 7865) Cys Glu Phe Cys Leu Asn Pro Ala Cys Gly Ala Cys
(SEQ ID NO: 7866) Cys Glu Phe Cys Leu Asn Pro Thr Cys Thr Gly Cys
(SEQ ID NO: 7867) Cys Glu Phe Cys Leu Asn Pro Thr Cys Thr Ala Cys
(SEQ ID NO: 7868) Cys Glu Phe Cys Leu Asn Pro Thr Cys Val Gly Cys
(SEQ ID NO: 7869) Cys Glu Phe Cys Leu Asn Pro Thr Cys Val Ala Cys
(SEQ ID NO: 7870) Cys Glu Phe Cys Leu Asn Pro Thr Cys Gly Gly Cys
(SEQ ID NO: 7871) Cys Glu Phe Cys Leu Asn Pro Thr Cys Gly Ala Cys
(SEQ ID NO: 7872) Cys Glu Phe Cys Leu Asn Gly Ala Cys Thr Gly Cys
(SEQ ID NO: 7873) Cys Glu Phe Cys Leu Asn Gly Ala Cys Thr Ala Cys
(SEQ ID NO: 7874) Cys Glu Phe Cys Leu Asn Gly Ala Cys Val Gly Cys
(SEQ ID NO: 7875) Cys Glu Phe Cys Leu Asn Gly Ala Cys Val Ala Cys
(SEQ ID NO: 7876) Cys Glu Phe Cys Leu Asn Gly Ala Cys Gly Gly Cys
(SEQ ID NO: 7877) Cys Glu Phe Cys Leu Asn Gly Ala Cys Gly Ala Cys
(SEQ ID NO: 7878) Cys Glu Phe Cys Leu Asn Gly Thr Cys Thr Gly Cys
(SEQ ID NO: 7879) Cys Glu Phe Cys Leu Asn Gly Thr Cys Thr Ala Cys
(SEQ ID NO: 7880) Cys Glu Phe Cys Leu Asn Gly Thr Cys Val Gly Cys
(SEQ ID NO: 7881) Cys Glu Phe Cys Leu Asn Gly Thr Cys Val Ala Cys
(SEQ ID NO: 7882) Cys Glu Phe Cys Leu Asn Gly Thr Cys Gly Gly Cys
(SEQ ID NO: 7883) Cys Glu Phe Cys Leu Asn Gly Thr Cys Gly Ala Cys
(SEQ ID NO: 7884) Cys Glu Phe Cys Lys Asn Pro Ala Cys Thr Gly Cys
(SEQ ID NO: 7885) Cys Glu Phe Cys Lys Asn Pro Ala Cys Thr Ala Cys
(SEQ ID NO: 7886) Cys Glu Phe Cys Lys Asn Pro Ala Cys Val Gly Cys
(SEQ ID NO: 7887) Cys Glu Phe Cys Lys Asn Pro Ala Cys Val Ala Cys
(SEQ ID NO: 7888) Cys Glu Phe Cys Lys Asn Pro Ala Cys Gly Gly Cys
(SEQ ID NO: 7889) Cys Glu Phe Cys Lys Asn Pro Ala Cys Gly Ala Cys
(SEQ ID NO: 7890) Cys Glu Phe Cys Lys Asn Pro Thr Cys Thr Gly Cys
(SEQ ID NO: 7891) Cys Glu Phe Cys Lys Asn Pro Thr Cys Thr Ala Cys
(SEQ ID NO: 7892) Cys Glu Phe Cys Lys Asn Pro Thr Cys Val Gly Cys
(SEQ ID NO: 7893) Cys Glu Phe Cys Lys Asn Pro Thr Cys Val Ala Cys
(SEQ ID NO: 7894) Cys Glu Phe Cys Lys Asn Pro Thr Cys Gly Gly Cys
(SEQ ID NO: 7895) Cys Glu Phe Cys Lys Asn Pro Thr Cys Gly Ala Cys
(SEQ ID NO: 7896) Cys Glu Phe Cys Lys Asn Gly Ala Cys Thr Gly Cys
(SEQ ID NO: 7897) Cys Glu Phe Cys Lys Asn Gly Ala Cys Thr Ala Cys
(SEQ ID NO: 7898) Cys Glu Phe Cys Lys Asn Gly Ala Cys Val Gly Cys
(SEQ ID NO: 7899) Cys Glu Phe Cys Lys Asn Gly Ala Cys Val Ala Cys
(SEQ ID NO: 7900) Cys Glu Phe Cys Lys Asn Gly Ala Cys Gly Gly Cys
(SEQ ID NO: 7901) Cys Glu Phe Cys Lys Asn Gly Ala Cys Gly Ala Cys
(SEQ ID NO: 7902) Cys Glu Phe Cys Lys Asn Gly Thr Cys Thr Gly Cys

FIG. 3

(SEQ ID NO: 7903)  Cys Glu Phe Cys Lys Asn Gly Thr Cys Thr Ala Cys
(SEQ ID NO: 7904)  Cys Glu Phe Cys Lys Asn Gly Thr Cys Val Gly Cys
(SEQ ID NO: 7905)  Cys Glu Phe Cys Lys Asn Gly Thr Cys Val Ala Cys
(SEQ ID NO: 7906)  Cys Glu Phe Cys Lys Asn Gly Thr Cys Gly Gly Cys
(SEQ ID NO: 7907)  Cys Glu Phe Cys Lys Asn Gly Thr Cys Gly Ala Cys
(SEQ ID NO: 7908)  Cys Glu Phe Cys Met Asn Pro Ala Cys Thr Gly Cys
(SEQ ID NO: 7909)  Cys Glu Phe Cys Met Asn Pro Ala Cys Thr Ala Cys
(SEQ ID NO: 7910)  Cys Glu Phe Cys Met Asn Pro Ala Cys Val Gly Cys
(SEQ ID NO: 7911)  Cys Glu Phe Cys Met Asn Pro Ala Cys Val Ala Cys
(SEQ ID NO: 7912)  Cys Glu Phe Cys Met Asn Pro Ala Cys Gly Gly Cys
(SEQ ID NO: 7913)  Cys Glu Phe Cys Met Asn Pro Ala Cys Gly Ala Cys
(SEQ ID NO: 7914)  Cys Glu Phe Cys Met Asn Pro Thr Cys Thr Gly Cys
(SEQ ID NO: 7915)  Cys Glu Phe Cys Met Asn Pro Thr Cys Thr Ala Cys
(SEQ ID NO: 7916)  Cys Glu Phe Cys Met Asn Pro Thr Cys Val Gly Cys
(SEQ ID NO: 7917)  Cys Glu Phe Cys Met Asn Pro Thr Cys Val Ala Cys
(SEQ ID NO: 7918)  Cys Glu Phe Cys Met Asn Pro Thr Cys Gly Gly Cys
(SEQ ID NO: 7919)  Cys Glu Phe Cys Met Asn Pro Thr Cys Gly Ala Cys
(SEQ ID NO: 7920)  Cys Glu Phe Cys Met Asn Gly Ala Cys Thr Gly Cys
(SEQ ID NO: 7921)  Cys Glu Phe Cys Met Asn Gly Ala Cys Thr Ala Cys
(SEQ ID NO: 7922)  Cys Glu Phe Cys Met Asn Gly Ala Cys Val Gly Cys
(SEQ ID NO: 7923)  Cys Glu Phe Cys Met Asn Gly Ala Cys Val Ala Cys
(SEQ ID NO: 7924)  Cys Glu Phe Cys Met Asn Gly Ala Cys Gly Gly Cys
(SEQ ID NO: 7925)  Cys Glu Phe Cys Met Asn Gly Ala Cys Gly Ala Cys
(SEQ ID NO: 7926)  Cys Glu Phe Cys Met Asn Gly Thr Cys Thr Gly Cys
(SEQ ID NO: 7927)  Cys Glu Phe Cys Met Asn Gly Thr Cys Thr Ala Cys
(SEQ ID NO: 7928)  Cys Glu Phe Cys Met Asn Gly Thr Cys Val Gly Cys
(SEQ ID NO: 7929)  Cys Glu Phe Cys Met Asn Gly Thr Cys Val Ala Cys
(SEQ ID NO: 7930)  Cys Glu Phe Cys Met Asn Gly Thr Cys Gly Gly Cys
(SEQ ID NO: 7931)  Cys Glu Phe Cys Met Asn Gly Thr Cys Gly Ala Cys
(SEQ ID NO: 7932)  Cys Glu Phe Cys Phe Asn Pro Ala Cys Thr Gly Cys
(SEQ ID NO: 7933)  Cys Glu Phe Cys Phe Asn Pro Ala Cys Thr Ala Cys
(SEQ ID NO: 7934)  Cys Glu Phe Cys Phe Asn Pro Ala Cys Val Gly Cys
(SEQ ID NO: 7935)  Cys Glu Phe Cys Phe Asn Pro Ala Cys Val Ala Cys
(SEQ ID NO: 7936)  Cys Glu Phe Cys Phe Asn Pro Ala Cys Gly Gly Cys
(SEQ ID NO: 7937)  Cys Glu Phe Cys Phe Asn Pro Ala Cys Gly Ala Cys
(SEQ ID NO: 7938)  Cys Glu Phe Cys Phe Asn Pro Thr Cys Thr Gly Cys
(SEQ ID NO: 7939)  Cys Glu Phe Cys Phe Asn Pro Thr Cys Thr Ala Cys
(SEQ ID NO: 7940)  Cys Glu Phe Cys Phe Asn Pro Thr Cys Val Gly Cys
(SEQ ID NO: 7941)  Cys Glu Phe Cys Phe Asn Pro Thr Cys Val Ala Cys
(SEQ ID NO: 7942)  Cys Glu Phe Cys Phe Asn Pro Thr Cys Gly Gly Cys
(SEQ ID NO: 7943)  Cys Glu Phe Cys Phe Asn Pro Thr Cys Gly Ala Cys
(SEQ ID NO: 7944)  Cys Glu Phe Cys Phe Asn Gly Ala Cys Thr Gly Cys
(SEQ ID NO: 7945)  Cys Glu Phe Cys Phe Asn Gly Ala Cys Thr Ala Cys

FIG. 3

(SEQ ID NO: 7946)  Cys Glu Phe Cys Phe Asn Gly Ala Cys Val Gly Cys
(SEQ ID NO: 7947)  Cys Glu Phe Cys Phe Asn Gly Ala Cys Val Ala Cys
(SEQ ID NO: 7948)  Cys Glu Phe Cys Phe Asn Gly Ala Cys Gly Gly Cys
(SEQ ID NO: 7949)  Cys Glu Phe Cys Phe Asn Gly Ala Cys Gly Ala Cys
(SEQ ID NO: 7950)  Cys Glu Phe Cys Phe Asn Gly Thr Cys Thr Gly Cys
(SEQ ID NO: 7951)  Cys Glu Phe Cys Phe Asn Gly Thr Cys Thr Ala Cys
(SEQ ID NO: 7952)  Cys Glu Phe Cys Phe Asn Gly Thr Cys Val Gly Cys
(SEQ ID NO: 7953)  Cys Glu Phe Cys Phe Asn Gly Thr Cys Val Ala Cys
(SEQ ID NO: 7954)  Cys Glu Phe Cys Phe Asn Gly Thr Cys Gly Gly Cys
(SEQ ID NO: 7955)  Cys Glu Phe Cys Phe Asn Gly Thr Cys Gly Ala Cys
(SEQ ID NO: 7956)  Cys Glu Phe Cys Pro Asn Pro Ala Cys Thr Gly Cys
(SEQ ID NO: 7957)  Cys Glu Phe Cys Pro Asn Pro Ala Cys Thr Ala Cys
(SEQ ID NO: 7958)  Cys Glu Phe Cys Pro Asn Pro Ala Cys Val Gly Cys
(SEQ ID NO: 7959)  Cys Glu Phe Cys Pro Asn Pro Ala Cys Val Ala Cys
(SEQ ID NO: 7960)  Cys Glu Phe Cys Pro Asn Pro Ala Cys Gly Gly Cys
(SEQ ID NO: 7961)  Cys Glu Phe Cys Pro Asn Pro Ala Cys Gly Ala Cys
(SEQ ID NO: 7962)  Cys Glu Phe Cys Pro Asn Pro Thr Cys Thr Gly Cys
(SEQ ID NO: 7963)  Cys Glu Phe Cys Pro Asn Pro Thr Cys Thr Ala Cys
(SEQ ID NO: 7964)  Cys Glu Phe Cys Pro Asn Pro Thr Cys Val Gly Cys
(SEQ ID NO: 7965)  Cys Glu Phe Cys Pro Asn Pro Thr Cys Val Ala Cys
(SEQ ID NO: 7966)  Cys Glu Phe Cys Pro Asn Pro Thr Cys Gly Gly Cys
(SEQ ID NO: 7967)  Cys Glu Phe Cys Pro Asn Pro Thr Cys Gly Ala Cys
(SEQ ID NO: 7968)  Cys Glu Phe Cys Pro Asn Gly Ala Cys Thr Gly Cys
(SEQ ID NO: 7969)  Cys Glu Phe Cys Pro Asn Gly Ala Cys Thr Ala Cys
(SEQ ID NO: 7970)  Cys Glu Phe Cys Pro Asn Gly Ala Cys Val Gly Cys
(SEQ ID NO: 7971)  Cys Glu Phe Cys Pro Asn Gly Ala Cys Val Ala Cys
(SEQ ID NO: 7972)  Cys Glu Phe Cys Pro Asn Gly Ala Cys Gly Gly Cys
(SEQ ID NO: 7973)  Cys Glu Phe Cys Pro Asn Gly Ala Cys Gly Ala Cys
(SEQ ID NO: 7974)  Cys Glu Phe Cys Pro Asn Gly Thr Cys Thr Gly Cys
(SEQ ID NO: 7975)  Cys Glu Phe Cys Pro Asn Gly Thr Cys Thr Ala Cys
(SEQ ID NO: 7976)  Cys Glu Phe Cys Pro Asn Gly Thr Cys Val Gly Cys
(SEQ ID NO: 7977)  Cys Glu Phe Cys Pro Asn Gly Thr Cys Val Ala Cys
(SEQ ID NO: 7978)  Cys Glu Phe Cys Pro Asn Gly Thr Cys Gly Gly Cys
(SEQ ID NO: 7979)  Cys Glu Phe Cys Pro Asn Gly Thr Cys Gly Ala Cys
(SEQ ID NO: 7980)  Cys Glu Phe Cys Ser Asn Pro Ala Cys Thr Gly Cys
(SEQ ID NO: 7981)  Cys Glu Phe Cys Ser Asn Pro Ala Cys Thr Ala Cys
(SEQ ID NO: 7982)  Cys Glu Phe Cys Ser Asn Pro Ala Cys Val Gly Cys
(SEQ ID NO: 7983)  Cys Glu Phe Cys Ser Asn Pro Ala Cys Val Ala Cys
(SEQ ID NO: 7984)  Cys Glu Phe Cys Ser Asn Pro Ala Cys Gly Gly Cys
(SEQ ID NO: 7985)  Cys Glu Phe Cys Ser Asn Pro Ala Cys Gly Ala Cys
(SEQ ID NO: 7986)  Cys Glu Phe Cys Ser Asn Pro Thr Cys Thr Gly Cys
(SEQ ID NO: 7987)  Cys Glu Phe Cys Ser Asn Pro Thr Cys Thr Ala Cys
(SEQ ID NO: 7988)  Cys Glu Phe Cys Ser Asn Pro Thr Cys Val Gly Cys

FIG. 3

| | |
|---|---|
| (SEQ ID NO: 7989) | Cys Glu Phe Cys Ser Asn Pro Thr Cys Val Ala Cys |
| (SEQ ID NO: 7990) | Cys Glu Phe Cys Ser Asn Pro Thr Cys Gly Gly Cys |
| (SEQ ID NO: 7991) | Cys Glu Phe Cys Ser Asn Pro Thr Cys Gly Ala Cys |
| (SEQ ID NO: 7992) | Cys Glu Phe Cys Ser Asn Gly Ala Cys Thr Gly Cys |
| (SEQ ID NO: 7993) | Cys Glu Phe Cys Ser Asn Gly Ala Cys Thr Ala Cys |
| (SEQ ID NO: 7994) | Cys Glu Phe Cys Ser Asn Gly Ala Cys Val Gly Cys |
| (SEQ ID NO: 7995) | Cys Glu Phe Cys Ser Asn Gly Ala Cys Val Ala Cys |
| (SEQ ID NO: 7996) | Cys Glu Phe Cys Ser Asn Gly Ala Cys Gly Gly Cys |
| (SEQ ID NO: 7997) | Cys Glu Phe Cys Ser Asn Gly Ala Cys Gly Ala Cys |
| (SEQ ID NO: 7998) | Cys Glu Phe Cys Ser Asn Gly Thr Cys Thr Gly Cys |
| (SEQ ID NO: 7999) | Cys Glu Phe Cys Ser Asn Gly Thr Cys Thr Ala Cys |
| (SEQ ID NO: 8000) | Cys Glu Phe Cys Ser Asn Gly Thr Cys Val Gly Cys |
| (SEQ ID NO: 8001) | Cys Glu Phe Cys Ser Asn Gly Thr Cys Val Ala Cys |
| (SEQ ID NO: 8002) | Cys Glu Phe Cys Ser Asn Gly Thr Cys Gly Gly Cys |
| (SEQ ID NO: 8003) | Cys Glu Phe Cys Ser Asn Gly Thr Cys Gly Ala Cys |
| (SEQ ID NO: 8004) | Cys Glu Phe Cys Thr Asn Pro Ala Cys Thr Gly Cys |
| (SEQ ID NO: 8005) | Cys Glu Phe Cys Thr Asn Pro Ala Cys Thr Ala Cys |
| (SEQ ID NO: 8006) | Cys Glu Phe Cys Thr Asn Pro Ala Cys Val Gly Cys |
| (SEQ ID NO: 8007) | Cys Glu Phe Cys Thr Asn Pro Ala Cys Val Ala Cys |
| (SEQ ID NO: 8008) | Cys Glu Phe Cys Thr Asn Pro Ala Cys Gly Gly Cys |
| (SEQ ID NO: 8009) | Cys Glu Phe Cys Thr Asn Pro Ala Cys Gly Ala Cys |
| (SEQ ID NO: 8010) | Cys Glu Phe Cys Thr Asn Pro Thr Cys Thr Gly Cys |
| (SEQ ID NO: 8011) | Cys Glu Phe Cys Thr Asn Pro Thr Cys Thr Ala Cys |
| (SEQ ID NO: 8012) | Cys Glu Phe Cys Thr Asn Pro Thr Cys Val Gly Cys |
| (SEQ ID NO: 8013) | Cys Glu Phe Cys Thr Asn Pro Thr Cys Val Ala Cys |
| (SEQ ID NO: 8014) | Cys Glu Phe Cys Thr Asn Pro Thr Cys Gly Gly Cys |
| (SEQ ID NO: 8015) | Cys Glu Phe Cys Thr Asn Pro Thr Cys Gly Ala Cys |
| (SEQ ID NO: 8016) | Cys Glu Phe Cys Thr Asn Gly Ala Cys Thr Gly Cys |
| (SEQ ID NO: 8017) | Cys Glu Phe Cys Thr Asn Gly Ala Cys Thr Ala Cys |
| (SEQ ID NO: 8018) | Cys Glu Phe Cys Thr Asn Gly Ala Cys Val Gly Cys |
| (SEQ ID NO: 8019) | Cys Glu Phe Cys Thr Asn Gly Ala Cys Val Ala Cys |
| (SEQ ID NO: 8020) | Cys Glu Phe Cys Thr Asn Gly Ala Cys Gly Gly Cys |
| (SEQ ID NO: 8021) | Cys Glu Phe Cys Thr Asn Gly Ala Cys Gly Ala Cys |
| (SEQ ID NO: 8022) | Cys Glu Phe Cys Thr Asn Gly Thr Cys Thr Gly Cys |
| (SEQ ID NO: 8023) | Cys Glu Phe Cys Thr Asn Gly Thr Cys Thr Ala Cys |
| (SEQ ID NO: 8024) | Cys Glu Phe Cys Thr Asn Gly Thr Cys Val Gly Cys |
| (SEQ ID NO: 8025) | Cys Glu Phe Cys Thr Asn Gly Thr Cys Val Ala Cys |
| (SEQ ID NO: 8026) | Cys Glu Phe Cys Thr Asn Gly Thr Cys Gly Gly Cys |
| (SEQ ID NO: 8027) | Cys Glu Phe Cys Thr Asn Gly Thr Cys Gly Ala Cys |
| (SEQ ID NO: 8028) | Cys Glu Phe Cys Trp Asn Pro Ala Cys Thr Gly Cys |
| (SEQ ID NO: 8029) | Cys Glu Phe Cys Trp Asn Pro Ala Cys Thr Ala Cys |
| (SEQ ID NO: 8030) | Cys Glu Phe Cys Trp Asn Pro Ala Cys Val Gly Cys |
| (SEQ ID NO: 8031) | Cys Glu Phe Cys Trp Asn Pro Ala Cys Val Ala Cys |

FIG. 3

(SEQ ID NO: 8032) Cys Glu Phe Cys Trp Asn Pro Ala Cys Gly Gly Cys
(SEQ ID NO: 8033) Cys Glu Phe Cys Trp Asn Pro Ala Cys Gly Ala Cys
(SEQ ID NO: 8034) Cys Glu Phe Cys Trp Asn Pro Thr Cys Thr Gly Cys
(SEQ ID NO: 8035) Cys Glu Phe Cys Trp Asn Pro Thr Cys Thr Ala Cys
(SEQ ID NO: 8036) Cys Glu Phe Cys Trp Asn Pro Thr Cys Val Gly Cys
(SEQ ID NO: 8037) Cys Glu Phe Cys Trp Asn Pro Thr Cys Val Ala Cys
(SEQ ID NO: 8038) Cys Glu Phe Cys Trp Asn Pro Thr Cys Gly Gly Cys
(SEQ ID NO: 8039) Cys Glu Phe Cys Trp Asn Pro Thr Cys Gly Ala Cys
(SEQ ID NO: 8040) Cys Glu Phe Cys Trp Asn Gly Ala Cys Thr Gly Cys
(SEQ ID NO: 8041) Cys Glu Phe Cys Trp Asn Gly Ala Cys Thr Ala Cys
(SEQ ID NO: 8042) Cys Glu Phe Cys Trp Asn Gly Ala Cys Val Gly Cys
(SEQ ID NO: 8043) Cys Glu Phe Cys Trp Asn Gly Ala Cys Val Ala Cys
(SEQ ID NO: 8044) Cys Glu Phe Cys Trp Asn Gly Ala Cys Gly Gly Cys
(SEQ ID NO: 8045) Cys Glu Phe Cys Trp Asn Gly Ala Cys Gly Ala Cys
(SEQ ID NO: 8046) Cys Glu Phe Cys Trp Asn Gly Thr Cys Thr Gly Cys
(SEQ ID NO: 8047) Cys Glu Phe Cys Trp Asn Gly Thr Cys Thr Ala Cys
(SEQ ID NO: 8048) Cys Glu Phe Cys Trp Asn Gly Thr Cys Val Gly Cys
(SEQ ID NO: 8049) Cys Glu Phe Cys Trp Asn Gly Thr Cys Val Ala Cys
(SEQ ID NO: 8050) Cys Glu Phe Cys Trp Asn Gly Thr Cys Gly Gly Cys
(SEQ ID NO: 8051) Cys Glu Phe Cys Trp Asn Gly Thr Cys Gly Ala Cys
(SEQ ID NO: 8052) Cys Glu Phe Cys Tyr Asn Pro Ala Cys Thr Gly Cys
(SEQ ID NO: 8053) Cys Glu Phe Cys Tyr Asn Pro Ala Cys Thr Ala Cys
(SEQ ID NO: 8054) Cys Glu Phe Cys Tyr Asn Pro Ala Cys Val Gly Cys
(SEQ ID NO: 8055) Cys Glu Phe Cys Tyr Asn Pro Ala Cys Val Ala Cys
(SEQ ID NO: 8056) Cys Glu Phe Cys Tyr Asn Pro Ala Cys Gly Gly Cys
(SEQ ID NO: 8057) Cys Glu Phe Cys Tyr Asn Pro Ala Cys Gly Ala Cys
(SEQ ID NO: 8058) Cys Glu Phe Cys Tyr Asn Pro Thr Cys Thr Gly Cys
(SEQ ID NO: 8059) Cys Glu Phe Cys Tyr Asn Pro Thr Cys Thr Ala Cys
(SEQ ID NO: 8060) Cys Glu Phe Cys Tyr Asn Pro Thr Cys Val Gly Cys
(SEQ ID NO: 8061) Cys Glu Phe Cys Tyr Asn Pro Thr Cys Val Ala Cys
(SEQ ID NO: 8062) Cys Glu Phe Cys Tyr Asn Pro Thr Cys Gly Gly Cys
(SEQ ID NO: 8063) Cys Glu Phe Cys Tyr Asn Pro Thr Cys Gly Ala Cys
(SEQ ID NO: 8064) Cys Glu Phe Cys Tyr Asn Gly Ala Cys Thr Gly Cys
(SEQ ID NO: 8065) Cys Glu Phe Cys Tyr Asn Gly Ala Cys Thr Ala Cys
(SEQ ID NO: 8066) Cys Glu Phe Cys Tyr Asn Gly Ala Cys Val Gly Cys
(SEQ ID NO: 8067) Cys Glu Phe Cys Tyr Asn Gly Ala Cys Val Ala Cys
(SEQ ID NO: 8068) Cys Glu Phe Cys Tyr Asn Gly Ala Cys Gly Gly Cys
(SEQ ID NO: 8069) Cys Glu Phe Cys Tyr Asn Gly Ala Cys Gly Ala Cys
(SEQ ID NO: 8070) Cys Glu Phe Cys Tyr Asn Gly Thr Cys Thr Gly Cys
(SEQ ID NO: 8071) Cys Glu Phe Cys Tyr Asn Gly Thr Cys Thr Ala Cys
(SEQ ID NO: 8072) Cys Glu Phe Cys Tyr Asn Gly Thr Cys Val Gly Cys
(SEQ ID NO: 8073) Cys Glu Phe Cys Tyr Asn Gly Thr Cys Val Ala Cys
(SEQ ID NO: 8074) Cys Glu Phe Cys Tyr Asn Gly Thr Cys Gly Gly Cys

FIG. 3

(SEQ ID NO: 8075)  Cys Glu Phe Cys Tyr Asn Gly Thr Cys Gly Ala Cys
(SEQ ID NO: 8076)  Cys Glu Phe Cys Val Asn Pro Ala Cys Thr Gly Cys
(SEQ ID NO: 8077)  Cys Glu Phe Cys Val Asn Pro Ala Cys Thr Ala Cys
(SEQ ID NO: 8078)  Cys Glu Phe Cys Val Asn Pro Ala Cys Val Gly Cys
(SEQ ID NO: 8079)  Cys Glu Phe Cys Val Asn Pro Ala Cys Val Ala Cys
(SEQ ID NO: 8080)  Cys Glu Phe Cys Val Asn Pro Ala Cys Gly Gly Cys
(SEQ ID NO: 8081)  Cys Glu Phe Cys Val Asn Pro Ala Cys Gly Ala Cys
(SEQ ID NO: 8082)  Cys Glu Phe Cys Val Asn Pro Thr Cys Thr Gly Cys
(SEQ ID NO: 8083)  Cys Glu Phe Cys Val Asn Pro Thr Cys Thr Ala Cys
(SEQ ID NO: 8084)  Cys Glu Phe Cys Val Asn Pro Thr Cys Val Gly Cys
(SEQ ID NO: 8085)  Cys Glu Phe Cys Val Asn Pro Thr Cys Val Ala Cys
(SEQ ID NO: 8086)  Cys Glu Phe Cys Val Asn Pro Thr Cys Gly Gly Cys
(SEQ ID NO: 8087)  Cys Glu Phe Cys Val Asn Pro Thr Cys Gly Ala Cys
(SEQ ID NO: 8088)  Cys Glu Phe Cys Val Asn Gly Ala Cys Thr Gly Cys
(SEQ ID NO: 8089)  Cys Glu Phe Cys Val Asn Gly Ala Cys Thr Ala Cys
(SEQ ID NO: 8090)  Cys Glu Phe Cys Val Asn Gly Ala Cys Val Gly Cys
(SEQ ID NO: 8091)  Cys Glu Phe Cys Val Asn Gly Ala Cys Val Ala Cys
(SEQ ID NO: 8092)  Cys Glu Phe Cys Val Asn Gly Ala Cys Gly Gly Cys
(SEQ ID NO: 8093)  Cys Glu Phe Cys Val Asn Gly Ala Cys Gly Ala Cys
(SEQ ID NO: 8094)  Cys Glu Phe Cys Val Asn Gly Thr Cys Thr Gly Cys
(SEQ ID NO: 8095)  Cys Glu Phe Cys Val Asn Gly Thr Cys Thr Ala Cys
(SEQ ID NO: 8096)  Cys Glu Phe Cys Val Asn Gly Thr Cys Val Gly Cys
(SEQ ID NO: 8097)  Cys Glu Phe Cys Val Asn Gly Thr Cys Val Ala Cys
(SEQ ID NO: 8098)  Cys Glu Phe Cys Val Asn Gly Thr Cys Gly Gly Cys
(SEQ ID NO: 8099)  Cys Glu Phe Cys Val Asn Gly Thr Cys Gly Ala Cys
(SEQ ID NO: 8100)  Cys Glu Phe Cys --- Asn Pro Ala Cys Thr Gly Cys
(SEQ ID NO: 8101)  Cys Glu Phe Cys --- Asn Pro Ala Cys Thr Ala Cys
(SEQ ID NO: 8102)  Cys Glu Phe Cys --- Asn Pro Ala Cys Val Gly Cys
(SEQ ID NO: 8103)  Cys Glu Phe Cys --- Asn Pro Ala Cys Val Ala Cys
(SEQ ID NO: 8104)  Cys Glu Phe Cys --- Asn Pro Ala Cys Gly Gly Cys
(SEQ ID NO: 8105)  Cys Glu Phe Cys --- Asn Pro Ala Cys Gly Ala Cys
(SEQ ID NO: 8106)  Cys Glu Phe Cys --- Asn Pro Thr Cys Thr Gly Cys
(SEQ ID NO: 8107)  Cys Glu Phe Cys --- Asn Pro Thr Cys Thr Ala Cys
(SEQ ID NO: 8108)  Cys Glu Phe Cys --- Asn Pro Thr Cys Val Gly Cys
(SEQ ID NO: 8109)  Cys Glu Phe Cys --- Asn Pro Thr Cys Val Ala Cys
(SEQ ID NO: 8110)  Cys Glu Phe Cys --- Asn Pro Thr Cys Gly Gly Cys
(SEQ ID NO: 8111)  Cys Glu Phe Cys --- Asn Pro Thr Cys Gly Ala Cys
(SEQ ID NO: 8112)  Cys Glu Phe Cys --- Asn Gly Ala Cys Thr Gly Cys
(SEQ ID NO: 8113)  Cys Glu Phe Cys --- Asn Gly Ala Cys Thr Ala Cys
(SEQ ID NO: 8114)  Cys Glu Phe Cys --- Asn Gly Ala Cys Val Gly Cys
(SEQ ID NO: 8115)  Cys Glu Phe Cys --- Asn Gly Ala Cys Val Ala Cys
(SEQ ID NO: 8116)  Cys Glu Phe Cys --- Asn Gly Ala Cys Gly Gly Cys
(SEQ ID NO: 8117)  Cys Glu Phe Cys --- Asn Gly Ala Cys Gly Ala Cys

FIG. 3

| | |
|---|---|
| (SEQ ID NO: 8118) | Cys Glu Phe Cys --- Asn Gly Thr Cys Thr Gly Cys |
| (SEQ ID NO: 8119) | Cys Glu Phe Cys --- Asn Gly Thr Cys Thr Ala Cys |
| (SEQ ID NO: 8120) | Cys Glu Phe Cys --- Asn Gly Thr Cys Val Gly Cys |
| (SEQ ID NO: 8121) | Cys Glu Phe Cys --- Asn Gly Thr Cys Val Ala Cys |
| (SEQ ID NO: 8122) | Cys Glu Phe Cys --- Asn Gly Thr Cys Gly Gly Cys |
| (SEQ ID NO: 8123) | Cys Glu Phe Cys --- Asn Gly Thr Cys Gly Ala Cys |
| (SEQ ID NO: 8124) | Cys Glu Leu Cys Ala Asn Pro Ala Cys Thr Gly Cys |
| (SEQ ID NO: 8125) | Cys Glu Leu Cys Ala Asn Pro Ala Cys Thr Ala Cys |
| (SEQ ID NO: 8126) | Cys Glu Leu Cys Ala Asn Pro Ala Cys Val Gly Cys |
| (SEQ ID NO: 8127) | Cys Glu Leu Cys Ala Asn Pro Ala Cys Val Ala Cys |
| (SEQ ID NO: 8128) | Cys Glu Leu Cys Ala Asn Pro Ala Cys Gly Gly Cys |
| (SEQ ID NO: 8129) | Cys Glu Leu Cys Ala Asn Pro Ala Cys Gly Ala Cys |
| (SEQ ID NO: 8130) | Cys Glu Leu Cys Ala Asn Pro Thr Cys Thr Gly Cys |
| (SEQ ID NO: 8131) | Cys Glu Leu Cys Ala Asn Pro Thr Cys Thr Ala Cys |
| (SEQ ID NO: 8132) | Cys Glu Leu Cys Ala Asn Pro Thr Cys Val Gly Cys |
| (SEQ ID NO: 8133) | Cys Glu Leu Cys Ala Asn Pro Thr Cys Val Ala Cys |
| (SEQ ID NO: 8134) | Cys Glu Leu Cys Ala Asn Pro Thr Cys Gly Gly Cys |
| (SEQ ID NO: 8135) | Cys Glu Leu Cys Ala Asn Pro Thr Cys Gly Ala Cys |
| (SEQ ID NO: 8136) | Cys Glu Leu Cys Ala Asn Gly Ala Cys Thr Gly Cys |
| (SEQ ID NO: 8137) | Cys Glu Leu Cys Ala Asn Gly Ala Cys Thr Ala Cys |
| (SEQ ID NO: 8138) | Cys Glu Leu Cys Ala Asn Gly Ala Cys Val Gly Cys |
| (SEQ ID NO: 8139) | Cys Glu Leu Cys Ala Asn Gly Ala Cys Val Ala Cys |
| (SEQ ID NO: 8140) | Cys Glu Leu Cys Ala Asn Gly Ala Cys Gly Gly Cys |
| (SEQ ID NO: 8141) | Cys Glu Leu Cys Ala Asn Gly Ala Cys Gly Ala Cys |
| (SEQ ID NO: 8142) | Cys Glu Leu Cys Ala Asn Gly Thr Cys Thr Gly Cys |
| (SEQ ID NO: 8143) | Cys Glu Leu Cys Ala Asn Gly Thr Cys Thr Ala Cys |
| (SEQ ID NO: 8144) | Cys Glu Leu Cys Ala Asn Gly Thr Cys Val Gly Cys |
| (SEQ ID NO: 8145) | Cys Glu Leu Cys Ala Asn Gly Thr Cys Val Ala Cys |
| (SEQ ID NO: 8146) | Cys Glu Leu Cys Ala Asn Gly Thr Cys Gly Gly Cys |
| (SEQ ID NO: 8147) | Cys Glu Leu Cys Ala Asn Gly Thr Cys Gly Ala Cys |
| (SEQ ID NO: 8148) | Cys Glu Leu Cys Arg Asn Pro Ala Cys Thr Gly Cys |
| (SEQ ID NO: 8149) | Cys Glu Leu Cys Arg Asn Pro Ala Cys Thr Ala Cys |
| (SEQ ID NO: 8150) | Cys Glu Leu Cys Arg Asn Pro Ala Cys Val Gly Cys |
| (SEQ ID NO: 8151) | Cys Glu Leu Cys Arg Asn Pro Ala Cys Val Ala Cys |
| (SEQ ID NO: 8152) | Cys Glu Leu Cys Arg Asn Pro Ala Cys Gly Gly Cys |
| (SEQ ID NO: 8153) | Cys Glu Leu Cys Arg Asn Pro Ala Cys Gly Ala Cys |
| (SEQ ID NO: 8154) | Cys Glu Leu Cys Arg Asn Pro Thr Cys Thr Gly Cys |
| (SEQ ID NO: 8155) | Cys Glu Leu Cys Arg Asn Pro Thr Cys Thr Ala Cys |
| (SEQ ID NO: 8156) | Cys Glu Leu Cys Arg Asn Pro Thr Cys Val Gly Cys |
| (SEQ ID NO: 8157) | Cys Glu Leu Cys Arg Asn Pro Thr Cys Val Ala Cys |
| (SEQ ID NO: 8158) | Cys Glu Leu Cys Arg Asn Pro Thr Cys Gly Gly Cys |
| (SEQ ID NO: 8159) | Cys Glu Leu Cys Arg Asn Pro Thr Cys Gly Ala Cys |
| (SEQ ID NO: 8160) | Cys Glu Leu Cys Arg Asn Gly Ala Cys Thr Gly Cys |

FIG. 3

(SEQ ID NO: 8161)  Cys Glu Leu Cys Arg Asn Gly Ala Cys Thr Ala Cys
(SEQ ID NO: 8162)  Cys Glu Leu Cys Arg Asn Gly Ala Cys Val Gly Cys
(SEQ ID NO: 8163)  Cys Glu Leu Cys Arg Asn Gly Ala Cys Val Ala Cys
(SEQ ID NO: 8164)  Cys Glu Leu Cys Arg Asn Gly Ala Cys Gly Gly Cys
(SEQ ID NO: 8165)  Cys Glu Leu Cys Arg Asn Gly Ala Cys Gly Ala Cys
(SEQ ID NO: 8166)  Cys Glu Leu Cys Arg Asn Gly Thr Cys Thr Gly Cys
(SEQ ID NO: 8167)  Cys Glu Leu Cys Arg Asn Gly Thr Cys Thr Ala Cys
(SEQ ID NO: 8168)  Cys Glu Leu Cys Arg Asn Gly Thr Cys Val Gly Cys
(SEQ ID NO: 8169)  Cys Glu Leu Cys Arg Asn Gly Thr Cys Val Ala Cys
(SEQ ID NO: 8170)  Cys Glu Leu Cys Arg Asn Gly Thr Cys Gly Gly Cys
(SEQ ID NO: 8171)  Cys Glu Leu Cys Arg Asn Gly Thr Cys Gly Ala Cys
(SEQ ID NO: 8172)  Cys Glu Leu Cys Asn Asn Pro Ala Cys Thr Gly Cys
(SEQ ID NO: 8173)  Cys Glu Leu Cys Asn Asn Pro Ala Cys Thr Ala Cys
(SEQ ID NO: 8174)  Cys Glu Leu Cys Asn Asn Pro Ala Cys Val Gly Cys
(SEQ ID NO: 8175)  Cys Glu Leu Cys Asn Asn Pro Ala Cys Val Ala Cys
(SEQ ID NO: 8176)  Cys Glu Leu Cys Asn Asn Pro Ala Cys Gly Gly Cys
(SEQ ID NO: 8177)  Cys Glu Leu Cys Asn Asn Pro Ala Cys Gly Ala Cys
(SEQ ID NO: 8178)  Cys Glu Leu Cys Asn Asn Pro Thr Cys Thr Gly Cys
(SEQ ID NO: 8179)  Cys Glu Leu Cys Asn Asn Pro Thr Cys Thr Ala Cys
(SEQ ID NO: 8180)  Cys Glu Leu Cys Asn Asn Pro Thr Cys Val Gly Cys
(SEQ ID NO: 8181)  Cys Glu Leu Cys Asn Asn Pro Thr Cys Val Ala Cys
(SEQ ID NO: 8182)  Cys Glu Leu Cys Asn Asn Pro Thr Cys Gly Gly Cys
(SEQ ID NO: 8183)  Cys Glu Leu Cys Asn Asn Pro Thr Cys Gly Ala Cys
(SEQ ID NO: 8184)  Cys Glu Leu Cys Asn Asn Gly Ala Cys Thr Gly Cys
(SEQ ID NO: 8185)  Cys Glu Leu Cys Asn Asn Gly Ala Cys Thr Ala Cys
(SEQ ID NO: 8186)  Cys Glu Leu Cys Asn Asn Gly Ala Cys Val Gly Cys
(SEQ ID NO: 8187)  Cys Glu Leu Cys Asn Asn Gly Ala Cys Val Ala Cys
(SEQ ID NO: 8188)  Cys Glu Leu Cys Asn Asn Gly Ala Cys Gly Gly Cys
(SEQ ID NO: 8189)  Cys Glu Leu Cys Asn Asn Gly Ala Cys Gly Ala Cys
(SEQ ID NO: 8190)  Cys Glu Leu Cys Asn Asn Gly Thr Cys Thr Gly Cys
(SEQ ID NO: 8191)  Cys Glu Leu Cys Asn Asn Gly Thr Cys Thr Ala Cys
(SEQ ID NO: 8192)  Cys Glu Leu Cys Asn Asn Gly Thr Cys Val Gly Cys
(SEQ ID NO: 8193)  Cys Glu Leu Cys Asn Asn Gly Thr Cys Val Ala Cys
(SEQ ID NO: 8194)  Cys Glu Leu Cys Asn Asn Gly Thr Cys Gly Gly Cys
(SEQ ID NO: 8195)  Cys Glu Leu Cys Asn Asn Gly Thr Cys Gly Ala Cys
(SEQ ID NO: 8196)  Cys Glu Leu Cys Asp Asn Pro Ala Cys Thr Gly Cys
(SEQ ID NO: 8197)  Cys Glu Leu Cys Asp Asn Pro Ala Cys Thr Ala Cys
(SEQ ID NO: 8198)  Cys Glu Leu Cys Asp Asn Pro Ala Cys Val Gly Cys
(SEQ ID NO: 8199)  Cys Glu Leu Cys Asp Asn Pro Ala Cys Val Ala Cys
(SEQ ID NO: 8200)  Cys Glu Leu Cys Asp Asn Pro Ala Cys Gly Gly Cys
(SEQ ID NO: 8201)  Cys Glu Leu Cys Asp Asn Pro Ala Cys Gly Ala Cys
(SEQ ID NO: 8202)  Cys Glu Leu Cys Asp Asn Pro Thr Cys Thr Gly Cys
(SEQ ID NO: 8203)  Cys Glu Leu Cys Asp Asn Pro Thr Cys Thr Ala Cys

FIG. 3

| | |
|---|---|
| (SEQ ID NO: 8204) | Cys Glu Leu Cys Asp Asn Pro Thr Cys Val Gly Cys |
| (SEQ ID NO: 8205) | Cys Glu Leu Cys Asp Asn Pro Thr Cys Val Ala Cys |
| (SEQ ID NO: 8206) | Cys Glu Leu Cys Asp Asn Pro Thr Cys Gly Gly Cys |
| (SEQ ID NO: 8207) | Cys Glu Leu Cys Asp Asn Pro Thr Cys Gly Ala Cys |
| (SEQ ID NO: 8208) | Cys Glu Leu Cys Asp Asn Gly Ala Cys Thr Gly Cys |
| (SEQ ID NO: 8209) | Cys Glu Leu Cys Asp Asn Gly Ala Cys Thr Ala Cys |
| (SEQ ID NO: 8210) | Cys Glu Leu Cys Asp Asn Gly Ala Cys Val Gly Cys |
| (SEQ ID NO: 8211) | Cys Glu Leu Cys Asp Asn Gly Ala Cys Val Ala Cys |
| (SEQ ID NO: 8212) | Cys Glu Leu Cys Asp Asn Gly Ala Cys Gly Gly Cys |
| (SEQ ID NO: 8213) | Cys Glu Leu Cys Asp Asn Gly Ala Cys Gly Ala Cys |
| (SEQ ID NO: 8214) | Cys Glu Leu Cys Asp Asn Gly Thr Cys Thr Gly Cys |
| (SEQ ID NO: 8215) | Cys Glu Leu Cys Asp Asn Gly Thr Cys Thr Ala Cys |
| (SEQ ID NO: 8216) | Cys Glu Leu Cys Asp Asn Gly Thr Cys Val Gly Cys |
| (SEQ ID NO: 8217) | Cys Glu Leu Cys Asp Asn Gly Thr Cys Val Ala Cys |
| (SEQ ID NO: 8218) | Cys Glu Leu Cys Asp Asn Gly Thr Cys Gly Gly Cys |
| (SEQ ID NO: 8219) | Cys Glu Leu Cys Asp Asn Gly Thr Cys Gly Ala Cys |
| (SEQ ID NO: 8220) | Cys Glu Leu Cys Gln Asn Pro Ala Cys Thr Gly Cys |
| (SEQ ID NO: 8221) | Cys Glu Leu Cys Gln Asn Pro Ala Cys Thr Ala Cys |
| (SEQ ID NO: 8222) | Cys Glu Leu Cys Gln Asn Pro Ala Cys Val Gly Cys |
| (SEQ ID NO: 8223) | Cys Glu Leu Cys Gln Asn Pro Ala Cys Val Ala Cys |
| (SEQ ID NO: 8224) | Cys Glu Leu Cys Gln Asn Pro Ala Cys Gly Gly Cys |
| (SEQ ID NO: 8225) | Cys Glu Leu Cys Gln Asn Pro Ala Cys Gly Ala Cys |
| (SEQ ID NO: 8226) | Cys Glu Leu Cys Gln Asn Pro Thr Cys Thr Gly Cys |
| (SEQ ID NO: 8227) | Cys Glu Leu Cys Gln Asn Pro Thr Cys Thr Ala Cys |
| (SEQ ID NO: 8228) | Cys Glu Leu Cys Gln Asn Pro Thr Cys Val Gly Cys |
| (SEQ ID NO: 8229) | Cys Glu Leu Cys Gln Asn Pro Thr Cys Val Ala Cys |
| (SEQ ID NO: 8230) | Cys Glu Leu Cys Gln Asn Pro Thr Cys Gly Gly Cys |
| (SEQ ID NO: 8231) | Cys Glu Leu Cys Gln Asn Pro Thr Cys Gly Ala Cys |
| (SEQ ID NO: 8232) | Cys Glu Leu Cys Gln Asn Gly Ala Cys Thr Gly Cys |
| (SEQ ID NO: 8233) | Cys Glu Leu Cys Gln Asn Gly Ala Cys Thr Ala Cys |
| (SEQ ID NO: 8234) | Cys Glu Leu Cys Gln Asn Gly Ala Cys Val Gly Cys |
| (SEQ ID NO: 8235) | Cys Glu Leu Cys Gln Asn Gly Ala Cys Val Ala Cys |
| (SEQ ID NO: 8236) | Cys Glu Leu Cys Gln Asn Gly Ala Cys Gly Gly Cys |
| (SEQ ID NO: 8237) | Cys Glu Leu Cys Gln Asn Gly Ala Cys Gly Ala Cys |
| (SEQ ID NO: 8238) | Cys Glu Leu Cys Gln Asn Gly Thr Cys Thr Gly Cys |
| (SEQ ID NO: 8239) | Cys Glu Leu Cys Gln Asn Gly Thr Cys Thr Ala Cys |
| (SEQ ID NO: 8240) | Cys Glu Leu Cys Gln Asn Gly Thr Cys Val Gly Cys |
| (SEQ ID NO: 8241) | Cys Glu Leu Cys Gln Asn Gly Thr Cys Val Ala Cys |
| (SEQ ID NO: 8242) | Cys Glu Leu Cys Gln Asn Gly Thr Cys Gly Gly Cys |
| (SEQ ID NO: 8243) | Cys Glu Leu Cys Gln Asn Gly Thr Cys Gly Ala Cys |
| (SEQ ID NO: 8244) | Cys Glu Leu Cys Glu Asn Pro Ala Cys Thr Gly Cys |
| (SEQ ID NO: 8245) | Cys Glu Leu Cys Glu Asn Pro Ala Cys Thr Ala Cys |
| (SEQ ID NO: 8246) | Cys Glu Leu Cys Glu Asn Pro Ala Cys Val Gly Cys |

FIG. 3

(SEQ ID NO: 8247)  Cys Glu Leu Cys Glu Asn Pro Ala Cys Val Ala Cys
(SEQ ID NO: 8248)  Cys Glu Leu Cys Glu Asn Pro Ala Cys Gly Gly Cys
(SEQ ID NO: 8249)  Cys Glu Leu Cys Glu Asn Pro Ala Cys Gly Ala Cys
(SEQ ID NO: 8250)  Cys Glu Leu Cys Glu Asn Pro Thr Cys Thr Gly Cys
(SEQ ID NO: 8251)  Cys Glu Leu Cys Glu Asn Pro Thr Cys Thr Ala Cys
(SEQ ID NO: 8252)  Cys Glu Leu Cys Glu Asn Pro Thr Cys Val Gly Cys
(SEQ ID NO: 8253)  Cys Glu Leu Cys Glu Asn Pro Thr Cys Val Ala Cys
(SEQ ID NO: 8254)  Cys Glu Leu Cys Glu Asn Pro Thr Cys Gly Gly Cys
(SEQ ID NO: 8255)  Cys Glu Leu Cys Glu Asn Pro Thr Cys Gly Ala Cys
(SEQ ID NO: 8256)  Cys Glu Leu Cys Glu Asn Gly Ala Cys Thr Gly Cys
(SEQ ID NO: 8257)  Cys Glu Leu Cys Glu Asn Gly Ala Cys Thr Ala Cys
(SEQ ID NO: 8258)  Cys Glu Leu Cys Glu Asn Gly Ala Cys Val Gly Cys
(SEQ ID NO: 8259)  Cys Glu Leu Cys Glu Asn Gly Ala Cys Val Ala Cys
(SEQ ID NO: 8260)  Cys Glu Leu Cys Glu Asn Gly Ala Cys Gly Gly Cys
(SEQ ID NO: 8261)  Cys Glu Leu Cys Glu Asn Gly Ala Cys Gly Ala Cys
(SEQ ID NO: 8262)  Cys Glu Leu Cys Glu Asn Gly Thr Cys Thr Gly Cys
(SEQ ID NO: 8263)  Cys Glu Leu Cys Glu Asn Gly Thr Cys Thr Ala Cys
(SEQ ID NO: 8264)  Cys Glu Leu Cys Glu Asn Gly Thr Cys Val Gly Cys
(SEQ ID NO: 8265)  Cys Glu Leu Cys Glu Asn Gly Thr Cys Val Ala Cys
(SEQ ID NO: 8266)  Cys Glu Leu Cys Glu Asn Gly Thr Cys Gly Gly Cys
(SEQ ID NO: 8267)  Cys Glu Leu Cys Glu Asn Gly Thr Cys Gly Ala Cys
(SEQ ID NO: 8268)  Cys Glu Leu Cys Gly Asn Pro Ala Cys Thr Gly Cys
(SEQ ID NO: 8269)  Cys Glu Leu Cys Gly Asn Pro Ala Cys Thr Ala Cys
(SEQ ID NO: 8270)  Cys Glu Leu Cys Gly Asn Pro Ala Cys Val Gly Cys
(SEQ ID NO: 8271)  Cys Glu Leu Cys Gly Asn Pro Ala Cys Val Ala Cys
(SEQ ID NO: 8272)  Cys Glu Leu Cys Gly Asn Pro Ala Cys Gly Gly Cys
(SEQ ID NO: 8273)  Cys Glu Leu Cys Gly Asn Pro Ala Cys Gly Ala Cys
(SEQ ID NO: 8274)  Cys Glu Leu Cys Gly Asn Pro Thr Cys Thr Gly Cys
(SEQ ID NO: 8275)  Cys Glu Leu Cys Gly Asn Pro Thr Cys Thr Ala Cys
(SEQ ID NO: 8276)  Cys Glu Leu Cys Gly Asn Pro Thr Cys Val Gly Cys
(SEQ ID NO: 8277)  Cys Glu Leu Cys Gly Asn Pro Thr Cys Val Ala Cys
(SEQ ID NO: 8278)  Cys Glu Leu Cys Gly Asn Pro Thr Cys Gly Gly Cys
(SEQ ID NO: 8279)  Cys Glu Leu Cys Gly Asn Pro Thr Cys Gly Ala Cys
(SEQ ID NO: 8280)  Cys Glu Leu Cys Gly Asn Gly Ala Cys Thr Gly Cys
(SEQ ID NO: 8281)  Cys Glu Leu Cys Gly Asn Gly Ala Cys Thr Ala Cys
(SEQ ID NO: 8282)  Cys Glu Leu Cys Gly Asn Gly Ala Cys Val Gly Cys
(SEQ ID NO: 8283)  Cys Glu Leu Cys Gly Asn Gly Ala Cys Val Ala Cys
(SEQ ID NO: 8284)  Cys Glu Leu Cys Gly Asn Gly Ala Cys Gly Gly Cys
(SEQ ID NO: 8285)  Cys Glu Leu Cys Gly Asn Gly Ala Cys Gly Ala Cys
(SEQ ID NO: 8286)  Cys Glu Leu Cys Gly Asn Gly Thr Cys Thr Gly Cys
(SEQ ID NO: 8287)  Cys Glu Leu Cys Gly Asn Gly Thr Cys Thr Ala Cys
(SEQ ID NO: 8288)  Cys Glu Leu Cys Gly Asn Gly Thr Cys Val Gly Cys
(SEQ ID NO: 8289)  Cys Glu Leu Cys Gly Asn Gly Thr Cys Val Ala Cys

FIG. 3

(SEQ ID NO: 8290) Cys Glu Leu Cys Gly Asn Gly Thr Cys Gly Gly Cys
(SEQ ID NO: 8291) Cys Glu Leu Cys Gly Asn Gly Thr Cys Gly Ala Cys
(SEQ ID NO: 8292) Cys Glu Leu Cys His Asn Pro Ala Cys Thr Gly Cys
(SEQ ID NO: 8293) Cys Glu Leu Cys His Asn Pro Ala Cys Thr Ala Cys
(SEQ ID NO: 8294) Cys Glu Leu Cys His Asn Pro Ala Cys Val Gly Cys
(SEQ ID NO: 8295) Cys Glu Leu Cys His Asn Pro Ala Cys Val Ala Cys
(SEQ ID NO: 8296) Cys Glu Leu Cys His Asn Pro Ala Cys Gly Gly Cys
(SEQ ID NO: 8297) Cys Glu Leu Cys His Asn Pro Ala Cys Gly Ala Cys
(SEQ ID NO: 8298) Cys Glu Leu Cys His Asn Pro Thr Cys Thr Gly Cys
(SEQ ID NO: 8299) Cys Glu Leu Cys His Asn Pro Thr Cys Thr Ala Cys
(SEQ ID NO: 8300) Cys Glu Leu Cys His Asn Pro Thr Cys Val Gly Cys
(SEQ ID NO: 8301) Cys Glu Leu Cys His Asn Pro Thr Cys Val Ala Cys
(SEQ ID NO: 8302) Cys Glu Leu Cys His Asn Pro Thr Cys Gly Gly Cys
(SEQ ID NO: 8303) Cys Glu Leu Cys His Asn Pro Thr Cys Gly Ala Cys
(SEQ ID NO: 8304) Cys Glu Leu Cys His Asn Gly Ala Cys Thr Gly Cys
(SEQ ID NO: 8305) Cys Glu Leu Cys His Asn Gly Ala Cys Thr Ala Cys
(SEQ ID NO: 8306) Cys Glu Leu Cys His Asn Gly Ala Cys Val Gly Cys
(SEQ ID NO: 8307) Cys Glu Leu Cys His Asn Gly Ala Cys Val Ala Cys
(SEQ ID NO: 8308) Cys Glu Leu Cys His Asn Gly Ala Cys Gly Gly Cys
(SEQ ID NO: 8309) Cys Glu Leu Cys His Asn Gly Ala Cys Gly Ala Cys
(SEQ ID NO: 8310) Cys Glu Leu Cys His Asn Gly Thr Cys Thr Gly Cys
(SEQ ID NO: 8311) Cys Glu Leu Cys His Asn Gly Thr Cys Thr Ala Cys
(SEQ ID NO: 8312) Cys Glu Leu Cys His Asn Gly Thr Cys Val Gly Cys
(SEQ ID NO: 8313) Cys Glu Leu Cys His Asn Gly Thr Cys Val Ala Cys
(SEQ ID NO: 8314) Cys Glu Leu Cys His Asn Gly Thr Cys Gly Gly Cys
(SEQ ID NO: 8315) Cys Glu Leu Cys His Asn Gly Thr Cys Gly Ala Cys
(SEQ ID NO: 8316) Cys Glu Leu Cys Ile Asn Pro Ala Cys Thr Gly Cys
(SEQ ID NO: 8317) Cys Glu Leu Cys Ile Asn Pro Ala Cys Thr Ala Cys
(SEQ ID NO: 8318) Cys Glu Leu Cys Ile Asn Pro Ala Cys Val Gly Cys
(SEQ ID NO: 8319) Cys Glu Leu Cys Ile Asn Pro Ala Cys Val Ala Cys
(SEQ ID NO: 8320) Cys Glu Leu Cys Ile Asn Pro Ala Cys Gly Gly Cys
(SEQ ID NO: 8321) Cys Glu Leu Cys Ile Asn Pro Ala Cys Gly Ala Cys
(SEQ ID NO: 8322) Cys Glu Leu Cys Ile Asn Pro Thr Cys Thr Gly Cys
(SEQ ID NO: 8323) Cys Glu Leu Cys Ile Asn Pro Thr Cys Thr Ala Cys
(SEQ ID NO: 8324) Cys Glu Leu Cys Ile Asn Pro Thr Cys Val Gly Cys
(SEQ ID NO: 8325) Cys Glu Leu Cys Ile Asn Pro Thr Cys Val Ala Cys
(SEQ ID NO: 8326) Cys Glu Leu Cys Ile Asn Pro Thr Cys Gly Gly Cys
(SEQ ID NO: 8327) Cys Glu Leu Cys Ile Asn Pro Thr Cys Gly Ala Cys
(SEQ ID NO: 8328) Cys Glu Leu Cys Ile Asn Gly Ala Cys Thr Gly Cys
(SEQ ID NO: 8329) Cys Glu Leu Cys Ile Asn Gly Ala Cys Thr Ala Cys
(SEQ ID NO: 8330) Cys Glu Leu Cys Ile Asn Gly Ala Cys Val Gly Cys
(SEQ ID NO: 8331) Cys Glu Leu Cys Ile Asn Gly Ala Cys Val Ala Cys
(SEQ ID NO: 8332) Cys Glu Leu Cys Ile Asn Gly Ala Cys Gly Gly Cys

FIG. 3

(SEQ ID NO: 8333 )  Cys Glu Leu Cys Ile Asn Gly Ala Cys Gly Ala Cys
(SEQ ID NO: 8334 )  Cys Glu Leu Cys Ile Asn Gly Thr Cys Thr Gly Cys
(SEQ ID NO: 8335 )  Cys Glu Leu Cys Ile Asn Gly Thr Cys Thr Ala Cys
(SEQ ID NO: 8336 )  Cys Glu Leu Cys Ile Asn Gly Thr Cys Val Gly Cys
(SEQ ID NO: 8337 )  Cys Glu Leu Cys Ile Asn Gly Thr Cys Val Ala Cys
(SEQ ID NO: 8338 )  Cys Glu Leu Cys Ile Asn Gly Thr Cys Gly Gly Cys
(SEQ ID NO: 8339 )  Cys Glu Leu Cys Ile Asn Gly Thr Cys Gly Ala Cys
(SEQ ID NO: 8340 )  Cys Glu Leu Cys Leu Asn Pro Ala Cys Thr Gly Cys
(SEQ ID NO: 8341 )  Cys Glu Leu Cys Leu Asn Pro Ala Cys Thr Ala Cys
(SEQ ID NO: 8342 )  Cys Glu Leu Cys Leu Asn Pro Ala Cys Val Gly Cys
(SEQ ID NO: 8343 )  Cys Glu Leu Cys Leu Asn Pro Ala Cys Val Ala Cys
(SEQ ID NO: 8344 )  Cys Glu Leu Cys Leu Asn Pro Ala Cys Gly Gly Cys
(SEQ ID NO: 8345 )  Cys Glu Leu Cys Leu Asn Pro Ala Cys Gly Ala Cys
(SEQ ID NO: 8346 )  Cys Glu Leu Cys Leu Asn Pro Thr Cys Thr Gly Cys
(SEQ ID NO: 8347 )  Cys Glu Leu Cys Leu Asn Pro Thr Cys Thr Ala Cys
(SEQ ID NO: 8348 )  Cys Glu Leu Cys Leu Asn Pro Thr Cys Val Gly Cys
(SEQ ID NO: 8349 )  Cys Glu Leu Cys Leu Asn Pro Thr Cys Val Ala Cys
(SEQ ID NO: 8350 )  Cys Glu Leu Cys Leu Asn Pro Thr Cys Gly Gly Cys
(SEQ ID NO: 8351 )  Cys Glu Leu Cys Leu Asn Pro Thr Cys Gly Ala Cys
(SEQ ID NO: 8352 )  Cys Glu Leu Cys Leu Asn Gly Ala Cys Thr Gly Cys
(SEQ ID NO: 8353 )  Cys Glu Leu Cys Leu Asn Gly Ala Cys Thr Ala Cys
(SEQ ID NO: 8354 )  Cys Glu Leu Cys Leu Asn Gly Ala Cys Val Gly Cys
(SEQ ID NO: 8355 )  Cys Glu Leu Cys Leu Asn Gly Ala Cys Val Ala Cys
(SEQ ID NO: 8356 )  Cys Glu Leu Cys Leu Asn Gly Ala Cys Gly Gly Cys
(SEQ ID NO: 8357 )  Cys Glu Leu Cys Leu Asn Gly Ala Cys Gly Ala Cys
(SEQ ID NO: 8358 )  Cys Glu Leu Cys Leu Asn Gly Thr Cys Thr Gly Cys
(SEQ ID NO: 8359 )  Cys Glu Leu Cys Leu Asn Gly Thr Cys Thr Ala Cys
(SEQ ID NO: 8360 )  Cys Glu Leu Cys Leu Asn Gly Thr Cys Val Gly Cys
(SEQ ID NO: 8361 )  Cys Glu Leu Cys Leu Asn Gly Thr Cys Val Ala Cys
(SEQ ID NO: 8362 )  Cys Glu Leu Cys Leu Asn Gly Thr Cys Gly Gly Cys
(SEQ ID NO: 8363 )  Cys Glu Leu Cys Leu Asn Gly Thr Cys Gly Ala Cys
(SEQ ID NO: 8364 )  Cys Glu Leu Cys Lys Asn Pro Ala Cys Thr Gly Cys
(SEQ ID NO: 8365 )  Cys Glu Leu Cys Lys Asn Pro Ala Cys Thr Ala Cys
(SEQ ID NO: 8366 )  Cys Glu Leu Cys Lys Asn Pro Ala Cys Val Gly Cys
(SEQ ID NO: 8367 )  Cys Glu Leu Cys Lys Asn Pro Ala Cys Val Ala Cys
(SEQ ID NO: 8368 )  Cys Glu Leu Cys Lys Asn Pro Ala Cys Gly Gly Cys
(SEQ ID NO: 8369 )  Cys Glu Leu Cys Lys Asn Pro Ala Cys Gly Ala Cys
(SEQ ID NO: 8370 )  Cys Glu Leu Cys Lys Asn Pro Thr Cys Thr Gly Cys
(SEQ ID NO: 8371 )  Cys Glu Leu Cys Lys Asn Pro Thr Cys Thr Ala Cys
(SEQ ID NO: 8372 )  Cys Glu Leu Cys Lys Asn Pro Thr Cys Val Gly Cys
(SEQ ID NO: 8373 )  Cys Glu Leu Cys Lys Asn Pro Thr Cys Val Ala Cys
(SEQ ID NO: 8374 )  Cys Glu Leu Cys Lys Asn Pro Thr Cys Gly Gly Cys
(SEQ ID NO: 8375 )  Cys Glu Leu Cys Lys Asn Pro Thr Cys Gly Ala Cys

FIG. 3

(SEQ ID NO: 8376 )  Cys Glu Leu Cys Lys Asn Gly Ala Cys Thr Gly Cys
(SEQ ID NO: 8377 )  Cys Glu Leu Cys Lys Asn Gly Ala Cys Thr Ala Cys
(SEQ ID NO: 8378 )  Cys Glu Leu Cys Lys Asn Gly Ala Cys Val Gly Cys
(SEQ ID NO: 8379 )  Cys Glu Leu Cys Lys Asn Gly Ala Cys Val Ala Cys
(SEQ ID NO: 8380 )  Cys Glu Leu Cys Lys Asn Gly Ala Cys Gly Gly Cys
(SEQ ID NO: 8381 )  Cys Glu Leu Cys Lys Asn Gly Ala Cys Gly Ala Cys
(SEQ ID NO: 8382 )  Cys Glu Leu Cys Lys Asn Gly Thr Cys Thr Gly Cys
(SEQ ID NO: 8383 )  Cys Glu Leu Cys Lys Asn Gly Thr Cys Thr Ala Cys
(SEQ ID NO: 8384 )  Cys Glu Leu Cys Lys Asn Gly Thr Cys Val Gly Cys
(SEQ ID NO: 8385 )  Cys Glu Leu Cys Lys Asn Gly Thr Cys Val Ala Cys
(SEQ ID NO: 8386 )  Cys Glu Leu Cys Lys Asn Gly Thr Cys Gly Gly Cys
(SEQ ID NO: 8387 )  Cys Glu Leu Cys Lys Asn Gly Thr Cys Gly Ala Cys
(SEQ ID NO: 8388 )  Cys Glu Leu Cys Met Asn Pro Ala Cys Thr Gly Cys
(SEQ ID NO: 8389 )  Cys Glu Leu Cys Met Asn Pro Ala Cys Thr Ala Cys
(SEQ ID NO: 8390 )  Cys Glu Leu Cys Met Asn Pro Ala Cys Val Gly Cys
(SEQ ID NO: 8391 )  Cys Glu Leu Cys Met Asn Pro Ala Cys Val Ala Cys
(SEQ ID NO: 8392 )  Cys Glu Leu Cys Met Asn Pro Ala Cys Gly Gly Cys
(SEQ ID NO: 8393 )  Cys Glu Leu Cys Met Asn Pro Ala Cys Gly Ala Cys
(SEQ ID NO: 8394 )  Cys Glu Leu Cys Met Asn Pro Thr Cys Thr Gly Cys
(SEQ ID NO: 8395 )  Cys Glu Leu Cys Met Asn Pro Thr Cys Thr Ala Cys
(SEQ ID NO: 8396 )  Cys Glu Leu Cys Met Asn Pro Thr Cys Val Gly Cys
(SEQ ID NO: 8397 )  Cys Glu Leu Cys Met Asn Pro Thr Cys Val Ala Cys
(SEQ ID NO: 8398 )  Cys Glu Leu Cys Met Asn Pro Thr Cys Gly Gly Cys
(SEQ ID NO: 8399 )  Cys Glu Leu Cys Met Asn Pro Thr Cys Gly Ala Cys
(SEQ ID NO: 8400 )  Cys Glu Leu Cys Met Asn Gly Ala Cys Thr Gly Cys
(SEQ ID NO: 8401 )  Cys Glu Leu Cys Met Asn Gly Ala Cys Thr Ala Cys
(SEQ ID NO: 8402 )  Cys Glu Leu Cys Met Asn Gly Ala Cys Val Gly Cys
(SEQ ID NO: 8403 )  Cys Glu Leu Cys Met Asn Gly Ala Cys Val Ala Cys
(SEQ ID NO: 8404 )  Cys Glu Leu Cys Met Asn Gly Ala Cys Gly Gly Cys
(SEQ ID NO: 8405 )  Cys Glu Leu Cys Met Asn Gly Ala Cys Gly Ala Cys
(SEQ ID NO: 8406 )  Cys Glu Leu Cys Met Asn Gly Thr Cys Thr Gly Cys
(SEQ ID NO: 8407 )  Cys Glu Leu Cys Met Asn Gly Thr Cys Thr Ala Cys
(SEQ ID NO: 8408 )  Cys Glu Leu Cys Met Asn Gly Thr Cys Val Gly Cys
(SEQ ID NO: 8409 )  Cys Glu Leu Cys Met Asn Gly Thr Cys Val Ala Cys
(SEQ ID NO: 8410 )  Cys Glu Leu Cys Met Asn Gly Thr Cys Gly Gly Cys
(SEQ ID NO: 8411 )  Cys Glu Leu Cys Met Asn Gly Thr Cys Gly Ala Cys
(SEQ ID NO: 8412 )  Cys Glu Leu Cys Phe Asn Pro Ala Cys Thr Gly Cys
(SEQ ID NO: 8413 )  Cys Glu Leu Cys Phe Asn Pro Ala Cys Thr Ala Cys
(SEQ ID NO: 8414 )  Cys Glu Leu Cys Phe Asn Pro Ala Cys Val Gly Cys
(SEQ ID NO: 8415 )  Cys Glu Leu Cys Phe Asn Pro Ala Cys Val Ala Cys
(SEQ ID NO: 8416 )  Cys Glu Leu Cys Phe Asn Pro Ala Cys Gly Gly Cys
(SEQ ID NO: 8417 )  Cys Glu Leu Cys Phe Asn Pro Ala Cys Gly Ala Cys
(SEQ ID NO: 8418 )  Cys Glu Leu Cys Phe Asn Pro Thr Cys Thr Gly Cys

FIG. 3

| | |
|---|---|
| (SEQ ID NO: 8419) | Cys Glu Leu Cys Phe Asn Pro Thr Cys Thr Ala Cys |
| (SEQ ID NO: 8420) | Cys Glu Leu Cys Phe Asn Pro Thr Cys Val Gly Cys |
| (SEQ ID NO: 8421) | Cys Glu Leu Cys Phe Asn Pro Thr Cys Val Ala Cys |
| (SEQ ID NO: 8422) | Cys Glu Leu Cys Phe Asn Pro Thr Cys Gly Gly Cys |
| (SEQ ID NO: 8423) | Cys Glu Leu Cys Phe Asn Pro Thr Cys Gly Ala Cys |
| (SEQ ID NO: 8424) | Cys Glu Leu Cys Phe Asn Gly Ala Cys Thr Gly Cys |
| (SEQ ID NO: 8425) | Cys Glu Leu Cys Phe Asn Gly Ala Cys Thr Ala Cys |
| (SEQ ID NO: 8426) | Cys Glu Leu Cys Phe Asn Gly Ala Cys Val Gly Cys |
| (SEQ ID NO: 8427) | Cys Glu Leu Cys Phe Asn Gly Ala Cys Val Ala Cys |
| (SEQ ID NO: 8428) | Cys Glu Leu Cys Phe Asn Gly Ala Cys Gly Gly Cys |
| (SEQ ID NO: 8429) | Cys Glu Leu Cys Phe Asn Gly Ala Cys Gly Ala Cys |
| (SEQ ID NO: 8430) | Cys Glu Leu Cys Phe Asn Gly Thr Cys Thr Gly Cys |
| (SEQ ID NO: 8431) | Cys Glu Leu Cys Phe Asn Gly Thr Cys Thr Ala Cys |
| (SEQ ID NO: 8432) | Cys Glu Leu Cys Phe Asn Gly Thr Cys Val Gly Cys |
| (SEQ ID NO: 8433) | Cys Glu Leu Cys Phe Asn Gly Thr Cys Val Ala Cys |
| (SEQ ID NO: 8434) | Cys Glu Leu Cys Phe Asn Gly Thr Cys Gly Gly Cys |
| (SEQ ID NO: 8435) | Cys Glu Leu Cys Phe Asn Gly Thr Cys Gly Ala Cys |
| (SEQ ID NO: 8436) | Cys Glu Leu Cys Pro Asn Pro Ala Cys Thr Gly Cys |
| (SEQ ID NO: 8437) | Cys Glu Leu Cys Pro Asn Pro Ala Cys Thr Ala Cys |
| (SEQ ID NO: 8438) | Cys Glu Leu Cys Pro Asn Pro Ala Cys Val Gly Cys |
| (SEQ ID NO: 8439) | Cys Glu Leu Cys Pro Asn Pro Ala Cys Val Ala Cys |
| (SEQ ID NO: 8440) | Cys Glu Leu Cys Pro Asn Pro Ala Cys Gly Gly Cys |
| (SEQ ID NO: 8441) | Cys Glu Leu Cys Pro Asn Pro Ala Cys Gly Ala Cys |
| (SEQ ID NO: 8442) | Cys Glu Leu Cys Pro Asn Pro Thr Cys Thr Gly Cys |
| (SEQ ID NO: 8443) | Cys Glu Leu Cys Pro Asn Pro Thr Cys Thr Ala Cys |
| (SEQ ID NO: 8444) | Cys Glu Leu Cys Pro Asn Pro Thr Cys Val Gly Cys |
| (SEQ ID NO: 8445) | Cys Glu Leu Cys Pro Asn Pro Thr Cys Val Ala Cys |
| (SEQ ID NO: 8446) | Cys Glu Leu Cys Pro Asn Pro Thr Cys Gly Gly Cys |
| (SEQ ID NO: 8447) | Cys Glu Leu Cys Pro Asn Pro Thr Cys Gly Ala Cys |
| (SEQ ID NO: 8448) | Cys Glu Leu Cys Pro Asn Gly Ala Cys Thr Gly Cys |
| (SEQ ID NO: 8449) | Cys Glu Leu Cys Pro Asn Gly Ala Cys Thr Ala Cys |
| (SEQ ID NO: 8450) | Cys Glu Leu Cys Pro Asn Gly Ala Cys Val Gly Cys |
| (SEQ ID NO: 8451) | Cys Glu Leu Cys Pro Asn Gly Ala Cys Val Ala Cys |
| (SEQ ID NO: 8452) | Cys Glu Leu Cys Pro Asn Gly Ala Cys Gly Gly Cys |
| (SEQ ID NO: 8453) | Cys Glu Leu Cys Pro Asn Gly Ala Cys Gly Ala Cys |
| (SEQ ID NO: 8454) | Cys Glu Leu Cys Pro Asn Gly Thr Cys Thr Gly Cys |
| (SEQ ID NO: 8455) | Cys Glu Leu Cys Pro Asn Gly Thr Cys Thr Ala Cys |
| (SEQ ID NO: 8456) | Cys Glu Leu Cys Pro Asn Gly Thr Cys Val Gly Cys |
| (SEQ ID NO: 8457) | Cys Glu Leu Cys Pro Asn Gly Thr Cys Val Ala Cys |
| (SEQ ID NO: 8458) | Cys Glu Leu Cys Pro Asn Gly Thr Cys Gly Gly Cys |
| (SEQ ID NO: 8459) | Cys Glu Leu Cys Pro Asn Gly Thr Cys Gly Ala Cys |
| (SEQ ID NO: 8460) | Cys Glu Leu Cys Ser Asn Pro Ala Cys Thr Gly Cys |
| (SEQ ID NO: 8461) | Cys Glu Leu Cys Ser Asn Pro Ala Cys Thr Ala Cys |

FIG. 3

| | |
|---|---|
| (SEQ ID NO: 8462) | Cys Glu Leu Cys Ser Asn Pro Ala Cys Val Gly Cys |
| (SEQ ID NO: 8463) | Cys Glu Leu Cys Ser Asn Pro Ala Cys Val Ala Cys |
| (SEQ ID NO: 8464) | Cys Glu Leu Cys Ser Asn Pro Ala Cys Gly Gly Cys |
| (SEQ ID NO: 8465) | Cys Glu Leu Cys Ser Asn Pro Ala Cys Gly Ala Cys |
| (SEQ ID NO: 8466) | Cys Glu Leu Cys Ser Asn Pro Thr Cys Thr Gly Cys |
| (SEQ ID NO: 8467) | Cys Glu Leu Cys Ser Asn Pro Thr Cys Thr Ala Cys |
| (SEQ ID NO: 8468) | Cys Glu Leu Cys Ser Asn Pro Thr Cys Val Gly Cys |
| (SEQ ID NO: 8469) | Cys Glu Leu Cys Ser Asn Pro Thr Cys Val Ala Cys |
| (SEQ ID NO: 8470) | Cys Glu Leu Cys Ser Asn Pro Thr Cys Gly Gly Cys |
| (SEQ ID NO: 8471) | Cys Glu Leu Cys Ser Asn Pro Thr Cys Gly Ala Cys |
| (SEQ ID NO: 8472) | Cys Glu Leu Cys Ser Asn Gly Ala Cys Thr Gly Cys |
| (SEQ ID NO: 8473) | Cys Glu Leu Cys Ser Asn Gly Ala Cys Thr Ala Cys |
| (SEQ ID NO: 8474) | Cys Glu Leu Cys Ser Asn Gly Ala Cys Val Gly Cys |
| (SEQ ID NO: 8475) | Cys Glu Leu Cys Ser Asn Gly Ala Cys Val Ala Cys |
| (SEQ ID NO: 8476) | Cys Glu Leu Cys Ser Asn Gly Ala Cys Gly Gly Cys |
| (SEQ ID NO: 8477) | Cys Glu Leu Cys Ser Asn Gly Ala Cys Gly Ala Cys |
| (SEQ ID NO: 8478) | Cys Glu Leu Cys Ser Asn Gly Thr Cys Thr Gly Cys |
| (SEQ ID NO: 8479) | Cys Glu Leu Cys Ser Asn Gly Thr Cys Thr Ala Cys |
| (SEQ ID NO: 8480) | Cys Glu Leu Cys Ser Asn Gly Thr Cys Val Gly Cys |
| (SEQ ID NO: 8481) | Cys Glu Leu Cys Ser Asn Gly Thr Cys Val Ala Cys |
| (SEQ ID NO: 8482) | Cys Glu Leu Cys Ser Asn Gly Thr Cys Gly Gly Cys |
| (SEQ ID NO: 8483) | Cys Glu Leu Cys Ser Asn Gly Thr Cys Gly Ala Cys |
| (SEQ ID NO: 8484) | Cys Glu Leu Cys Thr Asn Pro Ala Cys Thr Gly Cys |
| (SEQ ID NO: 8485) | Cys Glu Leu Cys Thr Asn Pro Ala Cys Thr Ala Cys |
| (SEQ ID NO: 8486) | Cys Glu Leu Cys Thr Asn Pro Ala Cys Val Gly Cys |
| (SEQ ID NO: 8487) | Cys Glu Leu Cys Thr Asn Pro Ala Cys Val Ala Cys |
| (SEQ ID NO: 8488) | Cys Glu Leu Cys Thr Asn Pro Ala Cys Gly Gly Cys |
| (SEQ ID NO: 8489) | Cys Glu Leu Cys Thr Asn Pro Ala Cys Gly Ala Cys |
| (SEQ ID NO: 8490) | Cys Glu Leu Cys Thr Asn Pro Thr Cys Thr Gly Cys |
| (SEQ ID NO: 8491) | Cys Glu Leu Cys Thr Asn Pro Thr Cys Thr Ala Cys |
| (SEQ ID NO: 8492) | Cys Glu Leu Cys Thr Asn Pro Thr Cys Val Gly Cys |
| (SEQ ID NO: 8493) | Cys Glu Leu Cys Thr Asn Pro Thr Cys Val Ala Cys |
| (SEQ ID NO: 8494) | Cys Glu Leu Cys Thr Asn Pro Thr Cys Gly Gly Cys |
| (SEQ ID NO: 8495) | Cys Glu Leu Cys Thr Asn Pro Thr Cys Gly Ala Cys |
| (SEQ ID NO: 8496) | Cys Glu Leu Cys Thr Asn Gly Ala Cys Thr Gly Cys |
| (SEQ ID NO: 8497) | Cys Glu Leu Cys Thr Asn Gly Ala Cys Thr Ala Cys |
| (SEQ ID NO: 8498) | Cys Glu Leu Cys Thr Asn Gly Ala Cys Val Gly Cys |
| (SEQ ID NO: 8499) | Cys Glu Leu Cys Thr Asn Gly Ala Cys Val Ala Cys |
| (SEQ ID NO: 8500) | Cys Glu Leu Cys Thr Asn Gly Ala Cys Gly Gly Cys |
| (SEQ ID NO: 8501) | Cys Glu Leu Cys Thr Asn Gly Ala Cys Gly Ala Cys |
| (SEQ ID NO: 8502) | Cys Glu Leu Cys Thr Asn Gly Thr Cys Thr Gly Cys |
| (SEQ ID NO: 8503) | Cys Glu Leu Cys Thr Asn Gly Thr Cys Thr Ala Cys |
| (SEQ ID NO: 8504) | Cys Glu Leu Cys Thr Asn Gly Thr Cys Val Gly Cys |

FIG. 3

(SEQ ID NO: 8505) Cys Glu Leu Cys Thr Asn Gly Thr Cys Val Ala Cys
(SEQ ID NO: 8506) Cys Glu Leu Cys Thr Asn Gly Thr Cys Gly Gly Cys
(SEQ ID NO: 8507) Cys Glu Leu Cys Thr Asn Gly Thr Cys Gly Ala Cys
(SEQ ID NO: 8508) Cys Glu Leu Cys Trp Asn Pro Ala Cys Thr Gly Cys
(SEQ ID NO: 8509) Cys Glu Leu Cys Trp Asn Pro Ala Cys Thr Ala Cys
(SEQ ID NO: 8510) Cys Glu Leu Cys Trp Asn Pro Ala Cys Val Gly Cys
(SEQ ID NO: 8511) Cys Glu Leu Cys Trp Asn Pro Ala Cys Val Ala Cys
(SEQ ID NO: 8512) Cys Glu Leu Cys Trp Asn Pro Ala Cys Gly Gly Cys
(SEQ ID NO: 8513) Cys Glu Leu Cys Trp Asn Pro Ala Cys Gly Ala Cys
(SEQ ID NO: 8514) Cys Glu Leu Cys Trp Asn Pro Thr Cys Thr Gly Cys
(SEQ ID NO: 8515) Cys Glu Leu Cys Trp Asn Pro Thr Cys Thr Ala Cys
(SEQ ID NO: 8516) Cys Glu Leu Cys Trp Asn Pro Thr Cys Val Gly Cys
(SEQ ID NO: 8517) Cys Glu Leu Cys Trp Asn Pro Thr Cys Val Ala Cys
(SEQ ID NO: 8518) Cys Glu Leu Cys Trp Asn Pro Thr Cys Gly Gly Cys
(SEQ ID NO: 8519) Cys Glu Leu Cys Trp Asn Pro Thr Cys Gly Ala Cys
(SEQ ID NO: 8520) Cys Glu Leu Cys Trp Asn Gly Ala Cys Thr Gly Cys
(SEQ ID NO: 8521) Cys Glu Leu Cys Trp Asn Gly Ala Cys Thr Ala Cys
(SEQ ID NO: 8522) Cys Glu Leu Cys Trp Asn Gly Ala Cys Val Gly Cys
(SEQ ID NO: 8523) Cys Glu Leu Cys Trp Asn Gly Ala Cys Val Ala Cys
(SEQ ID NO: 8524) Cys Glu Leu Cys Trp Asn Gly Ala Cys Gly Gly Cys
(SEQ ID NO: 8525) Cys Glu Leu Cys Trp Asn Gly Ala Cys Gly Ala Cys
(SEQ ID NO: 8526) Cys Glu Leu Cys Trp Asn Gly Thr Cys Thr Gly Cys
(SEQ ID NO: 8527) Cys Glu Leu Cys Trp Asn Gly Thr Cys Thr Ala Cys
(SEQ ID NO: 8528) Cys Glu Leu Cys Trp Asn Gly Thr Cys Val Gly Cys
(SEQ ID NO: 8529) Cys Glu Leu Cys Trp Asn Gly Thr Cys Val Ala Cys
(SEQ ID NO: 8530) Cys Glu Leu Cys Trp Asn Gly Thr Cys Gly Gly Cys
(SEQ ID NO: 8531) Cys Glu Leu Cys Trp Asn Gly Thr Cys Gly Ala Cys
(SEQ ID NO: 8532) Cys Glu Leu Cys Tyr Asn Pro Ala Cys Thr Gly Cys
(SEQ ID NO: 8533) Cys Glu Leu Cys Tyr Asn Pro Ala Cys Thr Ala Cys
(SEQ ID NO: 8534) Cys Glu Leu Cys Tyr Asn Pro Ala Cys Val Gly Cys
(SEQ ID NO: 8535) Cys Glu Leu Cys Tyr Asn Pro Ala Cys Val Ala Cys
(SEQ ID NO: 8536) Cys Glu Leu Cys Tyr Asn Pro Ala Cys Gly Gly Cys
(SEQ ID NO: 8537) Cys Glu Leu Cys Tyr Asn Pro Ala Cys Gly Ala Cys
(SEQ ID NO: 8538) Cys Glu Leu Cys Tyr Asn Pro Thr Cys Thr Gly Cys
(SEQ ID NO: 8539) Cys Glu Leu Cys Tyr Asn Pro Thr Cys Thr Ala Cys
(SEQ ID NO: 8540) Cys Glu Leu Cys Tyr Asn Pro Thr Cys Val Gly Cys
(SEQ ID NO: 8541) Cys Glu Leu Cys Tyr Asn Pro Thr Cys Val Ala Cys
(SEQ ID NO: 8542) Cys Glu Leu Cys Tyr Asn Pro Thr Cys Gly Gly Cys
(SEQ ID NO: 8543) Cys Glu Leu Cys Tyr Asn Pro Thr Cys Gly Ala Cys
(SEQ ID NO: 8544) Cys Glu Leu Cys Tyr Asn Gly Ala Cys Thr Gly Cys
(SEQ ID NO: 8545) Cys Glu Leu Cys Tyr Asn Gly Ala Cys Thr Ala Cys
(SEQ ID NO: 8546) Cys Glu Leu Cys Tyr Asn Gly Ala Cys Val Gly Cys
(SEQ ID NO: 8547) Cys Glu Leu Cys Tyr Asn Gly Ala Cys Val Ala Cys

FIG. 3

| | |
|---|---|
| (SEQ ID NO: 8548) | Cys Glu Leu Cys Tyr Asn Gly Ala Cys Gly Gly Cys |
| (SEQ ID NO: 8549) | Cys Glu Leu Cys Tyr Asn Gly Ala Cys Gly Ala Cys |
| (SEQ ID NO: 8550) | Cys Glu Leu Cys Tyr Asn Gly Thr Cys Thr Gly Cys |
| (SEQ ID NO: 8551) | Cys Glu Leu Cys Tyr Asn Gly Thr Cys Thr Ala Cys |
| (SEQ ID NO: 8552) | Cys Glu Leu Cys Tyr Asn Gly Thr Cys Val Gly Cys |
| (SEQ ID NO: 8553) | Cys Glu Leu Cys Tyr Asn Gly Thr Cys Val Ala Cys |
| (SEQ ID NO: 8554) | Cys Glu Leu Cys Tyr Asn Gly Thr Cys Gly Gly Cys |
| (SEQ ID NO: 8555) | Cys Glu Leu Cys Tyr Asn Gly Thr Cys Gly Ala Cys |
| (SEQ ID NO: 8556) | Cys Glu Leu Cys Val Asn Pro Ala Cys Thr Gly Cys |
| (SEQ ID NO: 8557) | Cys Glu Leu Cys Val Asn Pro Ala Cys Thr Ala Cys |
| (SEQ ID NO: 8558) | Cys Glu Leu Cys Val Asn Pro Ala Cys Val Gly Cys |
| (SEQ ID NO: 8559) | Cys Glu Leu Cys Val Asn Pro Ala Cys Val Ala Cys |
| (SEQ ID NO: 8560) | Cys Glu Leu Cys Val Asn Pro Ala Cys Gly Gly Cys |
| (SEQ ID NO: 8561) | Cys Glu Leu Cys Val Asn Pro Ala Cys Gly Ala Cys |
| (SEQ ID NO: 8562) | Cys Glu Leu Cys Val Asn Pro Thr Cys Thr Gly Cys |
| (SEQ ID NO: 8563) | Cys Glu Leu Cys Val Asn Pro Thr Cys Thr Ala Cys |
| (SEQ ID NO: 8564) | Cys Glu Leu Cys Val Asn Pro Thr Cys Val Gly Cys |
| (SEQ ID NO: 8565) | Cys Glu Leu Cys Val Asn Pro Thr Cys Val Ala Cys |
| (SEQ ID NO: 8566) | Cys Glu Leu Cys Val Asn Pro Thr Cys Gly Gly Cys |
| (SEQ ID NO: 8567) | Cys Glu Leu Cys Val Asn Pro Thr Cys Gly Ala Cys |
| (SEQ ID NO: 8568) | Cys Glu Leu Cys Val Asn Gly Ala Cys Thr Gly Cys |
| (SEQ ID NO: 8569) | Cys Glu Leu Cys Val Asn Gly Ala Cys Thr Ala Cys |
| (SEQ ID NO: 8570) | Cys Glu Leu Cys Val Asn Gly Ala Cys Val Gly Cys |
| (SEQ ID NO: 8571) | Cys Glu Leu Cys Val Asn Gly Ala Cys Val Ala Cys |
| (SEQ ID NO: 8572) | Cys Glu Leu Cys Val Asn Gly Ala Cys Gly Gly Cys |
| (SEQ ID NO: 8573) | Cys Glu Leu Cys Val Asn Gly Ala Cys Gly Ala Cys |
| (SEQ ID NO: 8574) | Cys Glu Leu Cys Val Asn Gly Thr Cys Thr Gly Cys |
| (SEQ ID NO: 8575) | Cys Glu Leu Cys Val Asn Gly Thr Cys Thr Ala Cys |
| (SEQ ID NO: 8576) | Cys Glu Leu Cys Val Asn Gly Thr Cys Val Gly Cys |
| (SEQ ID NO: 8577) | Cys Glu Leu Cys Val Asn Gly Thr Cys Val Ala Cys |
| (SEQ ID NO: 8578) | Cys Glu Leu Cys Val Asn Gly Thr Cys Gly Gly Cys |
| (SEQ ID NO: 8579) | Cys Glu Leu Cys Val Asn Gly Thr Cys Gly Ala Cys |
| (SEQ ID NO: 8580) | Cys Glu Leu Cys --- Asn Pro Ala Cys Thr Gly Cys |
| (SEQ ID NO: 8581) | Cys Glu Leu Cys --- Asn Pro Ala Cys Thr Ala Cys |
| (SEQ ID NO: 8582) | Cys Glu Leu Cys --- Asn Pro Ala Cys Val Gly Cys |
| (SEQ ID NO: 8583) | Cys Glu Leu Cys --- Asn Pro Ala Cys Val Ala Cys |
| (SEQ ID NO: 8584) | Cys Glu Leu Cys --- Asn Pro Ala Cys Gly Gly Cys |
| (SEQ ID NO: 8585) | Cys Glu Leu Cys --- Asn Pro Ala Cys Gly Ala Cys |
| (SEQ ID NO: 8586) | Cys Glu Leu Cys --- Asn Pro Thr Cys Thr Gly Cys |
| (SEQ ID NO: 8587) | Cys Glu Leu Cys --- Asn Pro Thr Cys Thr Ala Cys |
| (SEQ ID NO: 8588) | Cys Glu Leu Cys --- Asn Pro Thr Cys Val Gly Cys |
| (SEQ ID NO: 8589) | Cys Glu Leu Cys --- Asn Pro Thr Cys Val Ala Cys |
| (SEQ ID NO: 8590) | Cys Glu Leu Cys --- Asn Pro Thr Cys Gly Gly Cys |

FIG. 3

| | | | | | | | | | | |
|---|---|---|---|---|---|---|---|---|---|---|
| (SEQ ID NO: 8591) | Cys | Glu | Leu | Cys | --- | Asn | Pro | Thr | Cys | Gly Ala Cys |
| (SEQ ID NO: 8592) | Cys | Glu | Leu | Cys | --- | Asn | Gly | Ala | Cys | Thr Gly Cys |
| (SEQ ID NO: 8593) | Cys | Glu | Leu | Cys | --- | Asn | Gly | Ala | Cys | Thr Ala Cys |
| (SEQ ID NO: 8594) | Cys | Glu | Leu | Cys | --- | Asn | Gly | Ala | Cys | Val Gly Cys |
| (SEQ ID NO: 8595) | Cys | Glu | Leu | Cys | --- | Asn | Gly | Ala | Cys | Val Ala Cys |
| (SEQ ID NO: 8596) | Cys | Glu | Leu | Cys | --- | Asn | Gly | Ala | Cys | Gly Gly Cys |
| (SEQ ID NO: 8597) | Cys | Glu | Leu | Cys | --- | Asn | Gly | Ala | Cys | Gly Ala Cys |
| (SEQ ID NO: 8598) | Cys | Glu | Leu | Cys | --- | Asn | Gly | Thr | Cys | Thr Gly Cys |
| (SEQ ID NO: 8599) | Cys | Glu | Leu | Cys | --- | Asn | Gly | Thr | Cys | Thr Ala Cys |
| (SEQ ID NO: 8600) | Cys | Glu | Leu | Cys | --- | Asn | Gly | Thr | Cys | Val Gly Cys |
| (SEQ ID NO: 8601) | Cys | Glu | Leu | Cys | --- | Asn | Gly | Thr | Cys | Val Ala Cys |
| (SEQ ID NO: 8602) | Cys | Glu | Leu | Cys | --- | Asn | Gly | Thr | Cys | Gly Gly Cys |
| (SEQ ID NO: 8603) | Cys | Glu | Leu | Cys | --- | Asn | Gly | Thr | Cys | Gly Ala Cys |

FIG. 3

METHOD FOR TREATING CONGESTIVE HEART FAILURE AND OTHER DISORDERS

This application is a continuation in part of U.S. Utility patent application Ser. No. 10/868,744, filed Jun. 14, 2004, which claims priority under 35 USC § 119(e) to U.S. Provisional Patent Application Ser. No. 60/478,492, filed on Jun. 13, 2003; U.S. Provisional Patent Application Ser. No. 60/532,361, filed on Dec. 23, 2003 and U.S. Provisional Patent Application Ser. No. 60/571,386, filed on May 14, 2004, the entire contents of which are hereby incorporated by reference.

TECHNICAL FIELD

This invention relates to methods and compositions for treating gastrointestinal disorders, obesity, congestive heart failure, benign prostatic hyperplasia and other disorders.

BACKGROUND

Irritable bowel syndrome (IBS) is a common chronic disorder of the intestine that affects 20 to 60 million individuals in the US alone (Lehman Brothers, Global Healthcare-Irritable Bowel Syndrome Industry Update, September 1999). IBS is the most common disorder diagnosed by gastroenterologists (28% of patients examined) and accounts for 12% of visits to primary care physicians (Camilleri 2001 *Gastroenterology* 120:652-668). In the US, the economic impact of IBS is estimated at $25 billion annually, through direct costs of health care use and indirect costs of absenteeism from work (Talley 1995 Gastroenterology 109:1736-1741). Patients with IBS have three times more absenteeism from work and report a reduced quality of life. Sufferers may be unable or unwilling to attend social events, maintain employment, or travel even short distances (Drossman 1993 *Dig Dis Sci* 38:1569-1580). There is a tremendous unmet medical need in this population since few prescription options exist to treat IBS.

Patients with IBS suffer from abdominal pain and a disturbed bowel pattern. Three subgroups of IBS patients have been defined based on the predominant bowel habit: constipation-predominant (c-IBS), diarrhea-predominant (d-IBS) or alternating between the two (a-IBS). Estimates of individuals who suffer from c-IBS range from 20-50% of the IBS patients with 30% frequently cited. In contrast to the other two subgroups that have a similar gender ratio, c-IBS is more common in women (ratio of 3:1) (Talley et al. 1995 *Am J Epidemiol* 142:76-83).

The definition and diagnostic criteria for IBS have been formalized in the "Rome Criteria" (Drossman et al. 1999 *Gut* 45: Suppl II:1-81), which are well accepted in clinical practice. However, the complexity of symptoms has not been explained by anatomical abnormalities or metabolic changes. This has led to the classification of IBS as a functional GI disorder, which is diagnosed on the basis of the Rome criteria and limited evaluation to exclude organic disease(Ringel et al. 2001 *Annu Rev Med* 52: 319-338). IBS is considered to be a "biopsychosocial" disorder resulting from a combination of three interacting mechanisms: altered bowel motility, an increased sensitivity of the intestine or colon to pain stimuli (visceral sensitivity) and psychosocial factors (Camilleri 2001 *Gastroenterology* 120:652-668). Recently, there has been increasing evidence for a role of inflammation in the etiology of IBS. Reports indicate that subsets of IBS patients have small but significant increases in colonic inflammatory and mast cells, increased inducible nitric oxide (NO) and synthase (iNOS) and altered expression of inflammatory cytokines (reviewed by Talley 2000, Medscape Coverage of DDW Week).

SUMMARY OF THE INVENTION

The present invention features compositions and related methods for treating IBS and other gastrointestinal disorders and conditions (e.g., gastrointestinal motility disorders, functional gastrointestinal disorders, gastroesophageal reflux disease (GERD), duodenogastric reflux, Crohn's disease, ulcerative colitis, inflammatory bowel disease, functional heartburn, dyspepsia (including functional dyspepsia or non-ulcer dyspepsia), gastroparesis, chronic intestinal pseudo-obstruction (colonic pseudoobstruction), and disorders and conditions associated with constipation, e.g., constipation associated with use of opiate pain killers, post-surgical constipation, and constipation associated with neuropathic disorders as well as other conditions and disorders. The compositions feature peptides that activate the guanylate cyclase C (GC-C) receptor.

The present invention also features compositions and related methods for treating obesity, congestive heart failure and benign prostatic hyperplasia (BPH).

Without being bound by any particular theory, in the case of IBS and other gastrointestinal disorders the peptides are useful because they can increase gastrointestinal motility.

Without being bound by any particular theory, in the case of IBS and other gastrointestinal disorders the peptides are useful, in part, because they can decrease inflammation.

Without being bound by any particular theory, in the case of IBS and other gastrointestinal disorders the peptides are also useful because they can decrease gastrointestinal pain or visceral pain.

The invention features pharmaceutical compositions comprising certain peptides that are capable of activating the guanylate-cyclase C (GC-C) receptor. Also within the invention are pharmaceutical compositions comprising a peptide or GC-C agonist of the invention as well as combination compositions comprising a peptide of the invention and one or more additional therapeutic agents including, without limitation, the agents described herein. The other agents can be administered with the peptides of the invention (simultaneously or sequentially). They can also be linked to a peptide of the invention to create therapeutic conjugates.

The invention includes methods for treating various gastrointestinal disorders by administering a peptide that acts as a partial or complete agonist of the GC-C receptor. The peptide contains up to four cysteines that form one or two disulfide bonds. In certain embodiments the disulfide bonds are replaced by other covalent cross-links and in some cases the cysteines are substituted by other residues to provide for alternative covalent cross-links. The peptides may also include at least one trypsin or chymotrypsin cleavage site and/or a carboxy-terminal analgesic peptide or small molecule, e.g., AspPhe or some other analgesic peptide. When present within the peptide, the analgesic peptide or small molecule may be preceded by a chymotrypsin or trypsin cleavage site that allows release of the analgesic peptide or small molecule. The peptides and methods of the invention are also useful for treating pain and inflammation associated with various disorders, including gastrointestinal disorders. Certain peptides include a functional chymotrypsin or trypsin cleavage site located so as to allow inactivation of the peptide upon cleavage. Certain peptides having a functional cleavage site undergo cleavage and gradual inactivation in the digestive tract, and this is desirable in some circumstances. In certain peptides, a functional chymotrypsin site is altered, increasing the stability of the peptide in vivo (e.g., guanylin).

The invention includes methods for treating other disorders such as congestive heart failure and benign prostatic hyperplasia by administering a peptide or small molecule (parenterally or orally) that acts as an agonist of the GC-C receptor. Such agents can be used in combination with natriuretic peptides (e.g., atrial natriuretic peptide, brain natriuretic peptide or C-type natriuretic peptide), a diuretic, or an inhibitor of angiotensin converting enzyme.

The invention features methods and compositions for increasing intestinal motility. Intestinal motility involves spontaneous coordinated distentions and contractions of the stomach, intestines, colon and rectum to move food through the gastrointestinal tract during the digestive process.

The peptide can contain additional carboxy terminal or amino terminal amino acids or both. For example, the peptide can include an amino terminal sequence that facilitates recombinant production of the peptide and is cleaved prior to administration of the peptide to a patient. The peptide can also include other amino terminal or carboxy terminal amino acids. In some cases the additional amino acids protect the peptide, stabilize the peptide or alter the activity of the peptide. In some cases some or all of these additional amino acids are removed prior to administration of the peptide to a patient. The peptide can include 1, 2, 3, 4, 5, 10, 15, 20, 25, 30, 40, 50, 60, 70 80, 90, 100 or more amino acids at its amino terminus or carboxy terminus or both. The number of flanking amino acids need not be the same. For example, there can be 10 additional amino acids at the amino terminus of the peptide and none at the carboxy terminus.

In certain embodiments the peptides include either one or two or more contiguous negatively charged amino acids (e.g., Asp or Glu) or one or two or more contiguous positively charged residues (e.g., Lys or Arg) or one or two or more contiguous positively or negatively charged amino acids at the carboxy terminus. In these embodiments all of the flanking amino acids at the carboxy terminus are either positively or negatively charged. In other embodiments the carboxy terminal charged amino acids are preceded by a Leu. For example, the following amino acid sequences can be added to the carboxy terminus of the peptide: Asp; Asp Lys; Lys Lys Lys Lys Lys Lys (SEQ ID NO:93); Asp Lys Lys Lys Lys Lys Lys (SEQ ID NO:94); Leu Lys Lys; and Leu Asp. It is also possible to simply add Leu at the carboxy terminus.

In a first aspect, the invention features a polypeptide comprising, consisting of, or consisting essentially of the amino acid sequence: $Xaa_1$ $Xaa_2$ $Xaa_3$ $Cys_4$ $Xaa_5$ $Xaa_6$ $Xaa_7$ $Xaa_8$ $Xaa_9$ $Xaa_{10}$ $Xaa_{11}$ $Cys_{12}$ $Xaa_{13}$ $Xaa_{14}$ $Xaa_{15}$ $Xaa_{16}$ (SEQ ID NO:1) wherein:

$Xaa_1$ is Ser, Asn, Tyr, Ala, Gln, Pro, Lys, Gly, or Thr, or is missing;

$Xaa_2$ is His, Asp, Glu, Ala, Ser, Asn, Gly, or is missing;

$Xaa_3$ is Thr, Asp, Ser, Glu, Pro, Val or Leu;

$Xaa_5$ is Asp, Ile or Glu;

$Xaa_6$ is Ile, Trp or Leu;

$Xaa_7$ is Cys, Ser, or Tyr;

$Xaa_8$ is Ala, Val, Thr, Ile, Met or is missing;

$Xaa_9$ is a) any amino acid, b) Phe, Tyr, Asn, Trp, c) an amino acid other than Phe, Trp, or Tyr, d) non-aromatic amino acid or e) is missing;

$Xaa_{10}$ is Ala, Val, Met, Thr or Ile;

$Xaa_{11}$ is Ala or Val;

$Xaa_{13}$ is Ala or Thr;

$Xaa_{14}$ is Gly, Ala or Ser;

$Xaa_{15}$ is Cys, Tyr or is missing; and $Xaa_{16}$ is: a) Trp, Tyr or Phe to create a chymotrypsin cleavage site; b) Lys or Arg to create a trypsin cleavage site; c) is missing or d) His or Leu or Ser.

In some embodiments, $Xaa_1$ is preceded by Lys or Tyr.

In certain embodiments, a Cys is replaced by any amino acid other than Cys. Certain such polypeptides will have fewer disulfide bonds.

In a related aspect the invention features a composition comprising a polypeptide comprising, consisting of, or consisting essentially of the amino acid sequence: $Xaa_1$ $Xaa_2$ $Xaa_3$ $Cys_4$ $Xaa_5$ $Xaa_6$ $Xaa_7$ $Xaa_8$ $Xaa_9$ $Xaa_{10}$ $Xaa_{11}$ $Cys_{12}$ $Xaa_{13}$ $Xaa_{14}$ $Xaa_{15}$ $Xaa_{16}$ (SEQ ID NO:1) wherein: $Xaa_1$ is Ser, Asn, Tyr, Ala, Gln, Pro, Lys, Gly, or Thr, or is missing; $Xaa_2$ is His, Asp, Glu, Ala, Ser, Asn, Gly, Pro or is missing; $Xaa_3$ is Thr, Asp, Ser, Glu, Pro, Val or Leu; $Xaa_5$ is Asp, Ile or Glu; $Xaa_6$ is Ile, Trp or Leu; $Xaa_7$ is Cys, Ser, or Tyr; $Xaa_8$ is Ala, Val, Thr, Ile, Met or is missing; $Xaa_9$ is Phe, Tyr, Asn, Trp, an amino acid other than Phe, Trp, or Tyr, is a non-aromatic amino acid or is missing; $Xaa_{10}$ is Ala, Val, Met, Thr or Ile; $Xaa_{11}$ is Ala or Val; $Xaa_{13}$ is Ala or Thr; $Xaa_{14}$ is Gly, Ala or Ser; $Xaa_{15}$ is Cys, Tyr or is missing; and $Xaa_{16}$ is: a) Trp, Tyr or Phe to create a chymotrypsin cleavage site; b) Lys or Arg to create a trypsin cleavage site; c) is missing or d) His or Leu or Ser and a pharmaceutically acceptable carrier. In related aspects, the invention features a pharmaceutically acceptable tablet, pill, capsule comprising the peptide.

In a related aspect, the invention features a polypeptide comprising, consisting of, or consisting essentially of the amino acid sequence: $Xaa_1$ $Xaa_2$ $Xaa_3$ $Cys_4$ $Xaa_5$ $Xaa_6$ $Xaa_7$ $Xaa_8$ $Xaa_9$ $Xaa_{10}$ $Xaa_{11}$ $Cys_{12}$ $Xaa_{13}$ $Xaa_{14}$ $Xaa_{15}$ $Xaa_{16}$ (SEQ ID NO:1) wherein:

$Xaa_1$ is Asn, any amino acid or is missing;

$Xaa_2$ is Asp, Glu, any amino acid or is missing;

$Xaa_3$ is Asp or Glu;

$Xaa_5$ is any amino acid or Glu;

$Xaa_6$ is any amino acid or Leu;

$Xaa_7$ is Cys;

$Xaa_8$ is any amino acid or Val;

$Xaa_9$ is Asn, Gln, Tyr;

$Xaa_{10}$ is is any amino acid or Val;

$Xaa_{11}$ is any amino acid or Ala;

$Xaa_{13}$ is is any amino acid or Thr;

$Xaa_{14}$ is is any amino acid or Gly;

$Xaa_{15}$ is Cys;

$Xaa_{16}$ is any amino acid, Leu or missing

In a related aspect, the invention features a polypeptide comprising, consisting of, or consisting essentially of the amino acid sequence: $Asn_1$, $Xaa_2$ $Xaa_3$ $Xaa_4$ $Glu_5$ $Leu_6$ $Xaa_7$ $Val_8$ $Asn_9$ $Xaa_{10}$ $Xaa_{11}$ $Xaa_{12}$ $Thr_{13}$ $Xaa_{14}$ $Xaa_{15}$ $Leu_{16}$ (SEQ ID NO:2)

$Xaa_2$ is Asp or Glu;

$Xaa_3$ is Asp or Glu;

$Xaa_4$ is Cys or Mpt (mercaptoproline) or Pen (penicillamine) or Dpr (diaminopropionic acid) or Asp or Glu;

$Xaa_7$ is Cys or Mpt (mercaptoproline) or Pen (penicillamine) or Dpr (diaminopropionic acid) or Asp or Glu;

$Xaa_{10}$ is Val or Pro;

$Xaa_{11}$ is Ala or Aib (alpha-aminoisobutyric acid);

$Xaa_{12}$ is Cys or Mpt (mercaptoproline) or Pen (penicillamine) or Dpr (diaminopropionic acid) or Asp or Glu;

$Xaa_{14}$ is Gly or Ala;

$Xaa_{15}$ is Cys or Mpt (mercaptoproline) or Pen (penicillamine) or Dpr (diaminopropionic acid) or Asp or Glu; and In certain embodiments, where $Xaa_{15}$ is other than Cys or is missing, $Xaa_7$ is Ser or an amino acid other than Cys.

In certain embodiments 1, 2, 3, 4, 5, 6, 7, 8, 9, 10, 11 or 12 of $Xaa_1$, $Xaa_2$, $Xaa_3$, $Xaa_5$, $Xaa_6$, $Xaa_7$, $Xaa_8$, $Xaa_9$, $Xaa_{10}$, $Xaa_{11}$, $Xaa_{13}$, $Xaa_{14}$, and $Xaa_{16}$ are any amino acid other than Cys.

In certain embodiments, $Xaa_9$ is any amino acid other than Gln. In other embodiments where $Xaa_2$ and $Xaa_3$ are Glu, $Xaa_9$ is any amino acid other than Gln.

In certain embodiments $Xaa_1$ and $Xaa_2$ are missing; $Xaa_3$ is Thr; $Xaa_5$ is Glu; $Xaa_6$ is Ile or Leu; $Xaa_8$ is Ala, Val, or Ile; $Xaa_9$ is Phe or Tyr; $Xaa_{10}$ is Ala or Val; $Xaa_{11}$ is Ala; $Xaa_{13}$ is Ala or Thr; $Xaa_{14}$ is Gly; and $Xaa_{16}$ is Trp, Tyr, Phe, Lys, Arg or is missing.

In certain embodiments the polypeptide comprising, consisting of, or consisting essentially of the amino acid sequence: $Xaa_1$ $Xaa_2$ $Xaa_3$ $Cys_4$ $Xaa_5$ $Xaa_6$ $Xaa_7$ $Xaa_8$ $Xaa_9$ $Xaa_{10}$ $Xaa_{11}$ $Cys_{12}$ $Xaa_{13}$ $Xaa_{14}$ $Xaa_{15}$ $Xaa_{16}$ (SEQ ID NO:1) is not cleaved after $Xaa_9$ by chymotrypsin. In these embodiments wherein:

$Xaa_1$ is Ser, Asn, Tyr, Ala, Gln, Pro, Lys, Gly, or Thr, or is missing;
$Xaa_2$ is His, Asp, Glu, Ala, Ser, Asn, or Gly, or is missing;
$Xaa_3$ is Thr, Asp, Ser, Glu, Pro, Val or Leu or is missing;
$Xaa_5$ is Asp, Ile or Glu;
$Xaa_6$ is Ile, Trp or Leu;
$Xaa_7$ is Cys, Ser, or Tyr;
$Xaa_8$ is Ala, Val, Thr, Ile, Met or is missing;
$Xaa_9$ is either: a) any amino acid other than Phe and Tyr, b) any amino acid other than Phe, Tyr, and Trp; c) any amino acid other than Phe, Tyr, Trp, Ile, Leu and Val; d) any amino acid other than Phe, Tyr, Trp, Ile, Leu, Val, and His; d) any non-aromatic amino acid or e) is missing;
$Xaa_{10}$ is Ala, Val, Met, Thr or Ile;
$Xaa_{11}$ is Ala or Val;
$Xaa_{13}$ is Ala or Thr;
$Xaa_{14}$ is Gly, Ala or Ser;
$Xaa_{15}$ is Cys, Tyr or is missing; and
$Xaa_{16}$ is: a) Trp, Tyr or Phe to create a chymotrypsin cleavage site; b) Lys or Arg to create a trypsin cleavage site; c) is missing or d) His or Leu or Ser.

In addition, the invention features variants of $Xaa_1$ $Xaa_2$ $Xaa_3$ $Cys_4$ $Xaa_5$ $Xaa_6$ $Xaa_7$ $Xaa_8$ $Xaa_9$ $Xaa_{10}$ $Xaa_{11}$ $Cys_{12}$ $Xaa_{13}$ $Xaa_{14}$ $Xaa_{15}$ $Xaa_{16}$ (SEQ ID NO:1) that is not cleaved after $Xaa_9$ by chymotrypsin due to the addition of an amino terminal lysine. An example of such a molecule is a human guanylin variant having an amino terminal lysine: KPGTCEICAYAACTGC (SEQ ID NO:3).

In certain embodiments of the peptide comprising, consisting of, or consisting essentially of the amino acid sequence: $Xaa_1$ $Xaa_2$ $Xaa_3$ $Cys_4$ $Xaa_5$ $Xaa_6$ $Xaa_7$ $Xaa_8$ $Xaa_9$ $Xaa_{10}$ $Xaa_{11}$ $Cys_{12}$ $Xaa_{13}$ $Xaa_{14}$ $Xaa_{15}$ $Xaa_{16}$ (SEQ ID NO:1) that is not cleaved after $Xaa_9$ by chymotrypsin, $Xaa_7$ and $Xaa_{15}$ are both Cys.

Also within the invention are variants of PGTCEICAYAACTGC (human guanylin) (SEQ ID NO:4) wherein Y is substituted by any amino acid other than a) Phe; b) any amino acid other than Phe and Trp; c) any amino acid other than Phe, Trp, Ile, Leu and Val; d) any amino acid other than Phe, Trp, Ile, Leu, Val and His; e) any non-aromatic amino acid or f) is missing.

In certain embodiments the polypeptide comprising, consisting of, or consisting essentially of the amino acid sequence: $Xaa_1$ $Xaa_2$ $Xaa_3$ $Cys_4$ $Xaa_5$ $Xaa_6$ $Xaa_7$ $Xaa_8$ $Xaa_9$ $Xaa_{10}$ $Xaa_{11}$ $Cys_{12}$ $Xaa_{13}$ $Xaa_{14}$ $Xaa_{15}$ $Xaa_{16}$ (SEQ ID NO:1) is not cleaved after $Xaa_9$ by either chymotrypsin or trypsin. In these embodiments wherein:

$Xaa_1$ is Ser, Asn, Tyr, Ala, Gln, Pro, Lys, Gly, or Thr, or is missing;
$Xaa_2$ is His, Asp, Glu, Ala, Ser, Asn, or Gly, or is missing;
$Xaa_3$ is Thr, Asp, Ser, Glu, Pro, Val or Leu or is missing;
$Xaa_5$ is Asp, Ile or Glu;
$Xaa_6$ is Ile, Trp or Leu;
$Xaa_7$ is Cys, Ser, or Tyr;
$Xaa_8$ is Ala, Val, Thr, Ile, Met or is missing;
$Xaa_9$ is either: a) any amino acid other than Lys, Arg, Phe and Tyr, b) any amino acid other than Lys, Arg, Phe, Tyr, and Trp, c) any amino acid other than Lys, Arg, Phe, Tyr, Trp, Ile, Leu and Val; d) any amino acid other than Lys, Arg, Phe, Tyr, Trp, Ile, Leu, Val, and His; or e) is missing;
$Xaa_{10}$ is Ala, Val, Met, Thr or Ile;
$Xaa_{11}$ is Ala or Val;
$Xaa_{13}$ is Ala or Thr;
$Xaa_{14}$ is Gly, Ala or Ser;
$Xaa_{15}$ is Cys, Tyr or is missing; and
$Xaa_{16}$ is: a) Trp, Tyr or Phe to create a chymotrypsin cleavage site; b) Lys or Arg to create a trypsin cleavage site; c) is missing or d) His or Leu or Ser.

In certain embodiments of the peptide comprising, consisting of, or consisting essentially of the amino acid sequence: $Xaa_1$ $Xaa_2$ $Xaa_3$ $Cys_4$ $Xaa_5$ $Xaa_6$ $Xaa_7$ $Xaa_8$ $Xaa_9$ $Xaa_{10}$ $Xaa_{11}$ $Cys_{12}$ $Xaa_{13}$ $Xaa_{14}$ $Xaa_{15}$ $Xaa_{16}$ (SEQ ID NO:1) that is not cleaved after $Xaa_9$ by chymotrypsin or trypsin, $Xaa_7$ and $Xaa_{15}$ are both Cys.

Useful variants of PGTCEICAYAACTGC (human guanylin) (SEQ ID NO:4) that should not be cleaved by chymotrypsin include:

```
PGTCEICASAACTGC       (SEQ ID NO:5)
PGTCEICATAACTGC       (SEQ ID NO:6)
PGTCEICANAACTGC       (SEQ ID NO:7)
PGTCEICAQAACTGC       (SEQ ID NO:8)
PGTCEICARAACTGC       (SEQ ID NO:9)
PGTCEICAEAACTGC       (SEQ ID NO:10)
PGTCEICADAACTGC       (SEQ ID NO:11)
PGTCEICAGAACTGC       (SEQ ID NO:12)
PGTCEICAAAACTGC       (SEQ ID NO:13)
PGTCEICAMAACTGC.      (SEQ ID NO:14)
```

Additional variants which are not likely to be cleaved by chymotrypsin under certain conditions include:

```
PGTCEICAIAACTGC       (SEQ ID NO:15)
PGTCEICALAACTGC       (SEQ ID NO:16)
PGTCEICAVAACTGC       (SEQ ID NO:17)
PGTCEICAHAACTGC       (SEQ ID NO:18)
```

The invention also features deletion variants of any of the peptides described herein in which one, two, three or four amino acids, other than a Cys, are deleted. Where two (or more) amino acids are deleted and the peptide comprises the sequence: $Cys_a$ Xaa Xaa $Cys_b$ Xaa Xaa Xaa Xaa $Cys_c$ Xaa Xaa $Cys_d$, in some embodiments two or more deletions can be located between $Cys_a$ and $Cys_b$ or between $Cys_b$ and $Cys_c$ or between $Cys_c$ and $Cys_d$. Thus, there can be two or more deletions between two Cys. However, in other embodiments there is at most one deletion between each Cys, i.e., there is no more than one deletion between each of $Cys_a$ and $Cys_b$, $Cys_b$ and $Cys_c$, and $Cys_c$ and $Cys_d$. Thus, the invention includes any of the peptides described herein comprising the sequence $Cys_a$ Xaa Xaa $Cys_b$ Xaa Xaa Xaa Xaa $Cys_c$ Xaa Xaa $Cys_d$ wherein: a) one amino acid between $Cys_a$ and $Cys_b$ is deleted; b) one amino acid between $Cys_b$ and $Cys_c$ is deleted; c) one amino acid between $Cys_c$ and $Cys_d$ is deleted; d) one amino acid between $Cys_a$ and $Cys_b$ is deleted and one amino acid between $Cys_b$ and $Cys_c$ is deleted; e) one amino acid between $Cys_a$ and $Cys_b$ is deleted and one amino acid between $Cys_c$ and $Cys_d$ is deleted; f) one amino acid between $Cys_b$ and $Cys_c$ is deleted and one amino acid between $Cys_c$ and $Cys_d$ is deleted; or g) one amino acid between $Cys_a$ and $Cys_b$ is deleted, one amino acid between $Cys_b$ and $Cys_c$ is deleted, and one amino acid between $Cys_c$ and $Cys_d$ is deleted. In addition, one or more amino acids preceding $Cys_a$ and/or one or more amino acids following $Cys_d$ can be deleted. In certain embodiments, the deletion variants are peptides that bind to and/or activate the GC-C receptor. In certain embodiments, the deletion variants increase cGMP levels.

The invention also features deletion variants of any of the peptides described herein in which one, two, three or four amino acids (or non-natural amino acids or natural or non-natural amino acid analogs), other than a Cys (or an amino acid substituted for Cys, e.g., an amino acid capable of forming a covalent bond to another amino acid) is deleted. Thus, additional variants include those in which a Cys is substituted by an amino acid capable of forming a covalent linkage with another amino acid (e.g., a Cys or a substitute therefore). Such amino acids include: Mpt (mercaptoproline) or Pen (penicillamine) or Dpr (diaminopropionic acid).

FIG. 1 includes deletion variants of human guanylin in which one, two, three or four amino acids are deleted. The deleted amino acids are between $Cys_a$ and $Cys_d$ as well as amino terminal to $Cys_a$.

The invention also features insertion variants of any of the peptides described herein in which one, two, three or four amino acids are inserted.

Where two (or more) amino acids are inserted and the peptide comprises the sequence: $Cys_a$ Xaa Xaa $Cys_b$ Xaa Xaa Xaa Xaa $Cys_c$ Xaa Xaa $Cys_d$, in some embodiments two or more insertions can be located between $Cys_a$ and $Cys_b$ or between $Cys_b$ and $Cys_c$ or between $Cys_c$ and $Cys_d$. However, in other embodiments there is at most one insertion between each of $Cys_a$ and $Cys_b$ or between $Cys_b$ and $Cys_c$ or between $Cys_c$ and $Cys_d$. Thus, the invention includes any of the peptides described herein comprising the sequence $Cys_a$ Xaa Xaa $Cys_b$ Xaa Xaa Xaa Xaa $Cys_c$ Xaa Xaa $Cys_d$ wherein: a) one amino acid is inserted between $Cys_a$ and $Cys_b$; b) one amino acid is inserted between $Cys_b$ and $Cys_c$; c) one amino acid is inserted between $Cys_c$ and $Cys_d$; d) one amino acid is inserted between $Cys_a$ and $Cys_b$ and one amino acid is inserted between $Cys_b$ and $Cys_c$; e) one amino acid is inserted between $Cys_a$ and $Cys_b$ and one amino acid is inserted between $Cys_c$ and $Cys_d$; f) one amino acid is inserted between $Cys_b$ and $Cys_c$ and one amino acid is inserted between $Cys_c$ and $Cys_d$ or g) one amino acid is inserted between $Cys_a$ and $Cys_b$, one amino acid is inserted between $Cys_b$ and $Cys_c$, and one amino acid is inserted between $Cys_c$ and $Cys_d$. In addition, one or more amino acids can be inserted preceding $Cys_a$ and/or one or more amino acids can be inserted following $Cys_d$. The insertions can be any natural or non-natural occurring amino acid (e.g., Gly or Ala) or amino acid analog and where there are more than one insertions present, they can be the same or different. In certain embodiments, the insertion variants are peptides that bind to and/or activate the GC-C receptor. In certain embodiments, the insertion variants are peptides that increase cGMP levels.

For example, the invention includes the following variants of

```
PGTCGEICAYAACTGC              (SEQ ID NO:19)
(human guanylin) include:

PGTCEGICAYAACTGC              (SEQ ID NO:20)

PGTCEIGCAYAACTGC              (SEQ ID NO:21)

PGTCEICGAYAACTGC              (SEQ ID NO:22)

PGTCEICAGYAACTGC              (SEQ ID NO:23)

PGTCEICAYGAACTGC              (SEQ ID NO:24)

PGTCEICAYAGACTGC              (SEQ ID NO:25)

PGTCEICAYAAGCTGC              (SEQ ID NO:26)

PGTCEICAYAACGTGC              (SEQ ID NO:27)

PGTCEICAYAACTGGC              (SEQ ID NO:28)

PGTCAEICAYAACTGC              (SEQ ID NO:29)

PGTCEAICAYAACTGC              (SEQ ID NO:30)

PGTCEIACAYAACTGC              (SEQ ID NO:31)

PGTCEICAAYAACTGC              (SEQ ID NO:32)

PGTCEICAYAAACTGC              (SEQ ID NO:33)

PGTCEICAYAACATGC              (SEQ ID NO:34)

PGTCEICAYAACTAGC              (SEQ ID NO:35)

PGTCEICAYAACTGAC              (SEQ ID NO:36)

PGTCAEICAAYAACTGC             (SEQ ID NO:37)

PGTCEAICAAYAACTGC             (SEQ ID NO:38)

PGTCEIACAAYAACTGC             (SEQ ID NO:39)
```

Other insertion variants of human guanylin can have up to four amino acids (i.e., 0, 1, 2, 3 or 4 natural or non-natural amino acids) inserted after each of the 15 amino acids in human guanylin. Thus, the invention includes peptides having the sequence: Pro $Xaa_{(0-4)}$ Gly $Xaa_{(0-4)}$ Thr $Xaa_{(0-4)}$ Cys $Xaa_{(0-4)}$ Glu $Xaa_{(0-4)}$ Ile $Xaa_{(0-4)}$ Cys $Xaa_{(0-4)}$ Ala $Xaa_{(0-4)}$ Tyr $Xaa_{(0-4)}$ Ala $Xaa_{(0-4)}$ Ala $Xaa_{(0-4)}$ Cys $Xaa_{(0-4)}$ Thr $Xaa_{(0-4)}$ Gly $Xaa_{(0-4)}$ Cys $Xaa_{(0-4)}$ (SEQ ID NO:95). The inserted amino acids can be any amino acid and can be the same or different. In certain embodiments the inserted amino acids are all Gly or all Ala or a combination of Gly and Ala.

Figure 2:
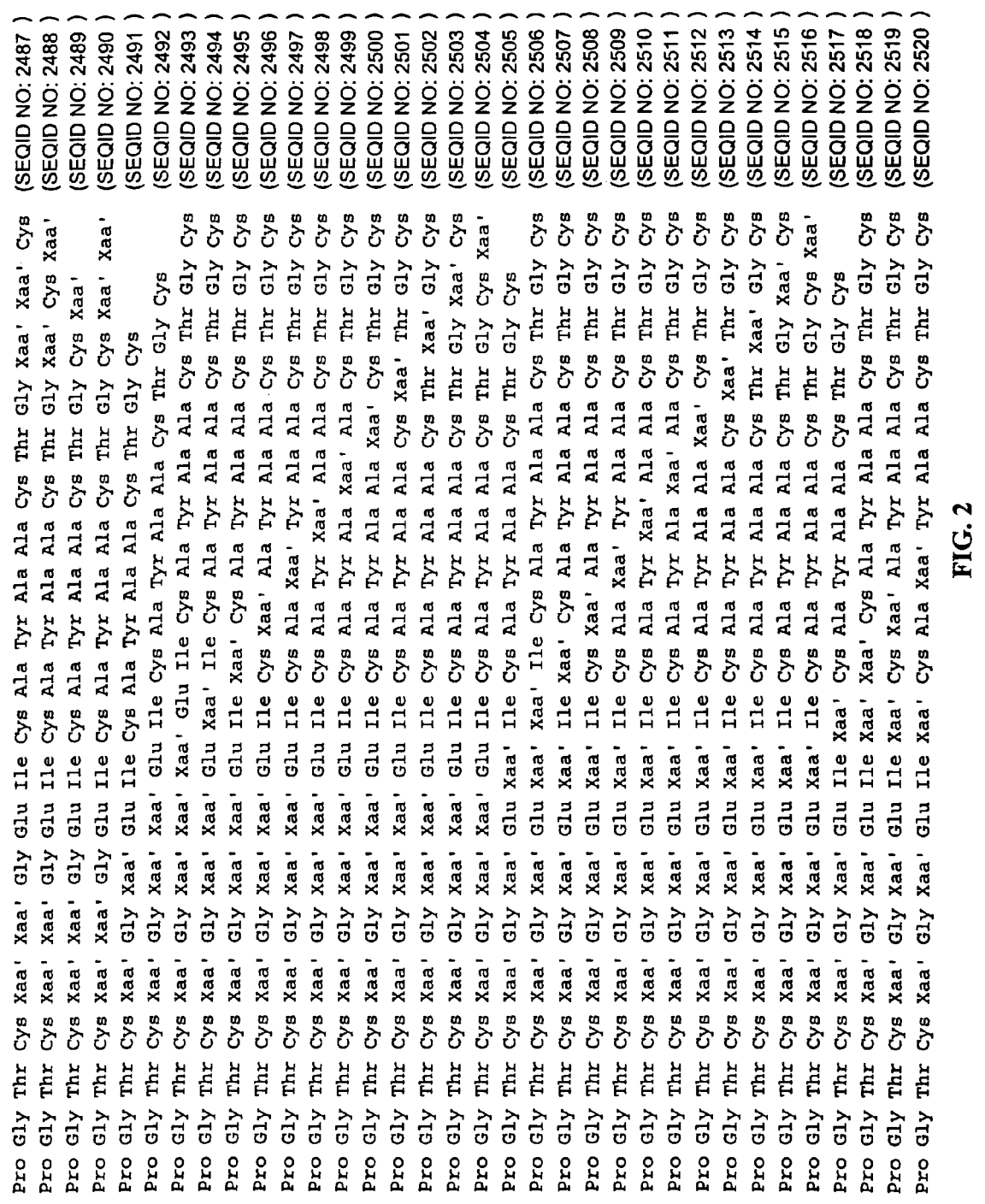

FIG. 2 depicts insertion variants of human guanylin in which one, two, three or four amino acids are inserted. The inserted amino acids are between $Cys_a$ and $Cys_d$ as well as amino terminal to $Cys_a$ and carboxy terminal to $Cys_d$.

The invention also features variants of peptides having the sequence $Xaa_1$ $Xaa_2$ $Xaa_3$ $Cys_4$ $Xaa_5$ $Xaa_6$ $Xaa_7$ $Xaa_8$ $Xaa_9$ $Xaa_{10}$ $Xaa_{11}$ $Cys_{12}$ $Xaa_{13}$ $Xaa_{14}$ $Xaa_{15}$ $Xaa_{16}$ (SEQ ID NO:1), e.g., variants of PGTCEICAYAACTGC human guanylin (SEQ ID NO:4) in which up to four amino acids are deleted and/or up to four amino acids are inserted. The insertions and deletions can be between Cys4 and Cys12 in SEQ ID NO:1 or they can be amino terminal to Cys4 and/or carboxy terminal to Cys12 in SEQ ID NO:1.

When $Xaa_{16}$ is Trp, Tyr or Phe, the peptide has a chymotrypsin cleavage site that is located at a position where cleavage will liberate the portion of the peptide carboxy-terminal to $Xaa_{16}$. When $Xaa_{16}$ is Lys or Arg, the peptide has a trypsin cleavage site that is located at a position where cleavage will liberate portion of the peptide carboxy-terminal to $Xaa_{16}$. Thus, if the peptide includes an analgesic peptide carboxy-terminal to $Xaa_{16}$, the peptide will be liberated in the digestive tract upon exposure to the appropriate protease. Among the analgesic peptides which can be included in the peptide are: AspPhe, endomorphin-1, endomorphin-2, nocistatin, dalargin, lupron, and ziconotide, substance P and other analgesic peptides described herein.

When $Xaa_1$ or the amino-terminal amino acid of the peptide of the invention (e.g., $Xaa_2$ or $Xaa_3$) is Trp, Tyr or Phe, the peptide has a chymotrypsin cleavage site that is located at a position where cleavage will liberate the portion of the peptide amino-terminal to $Xaa_1$ (or $Xaa_2$ or $Xaa_3$) along with $Xaa_1$, $Xaa_2$ or $Xaa_3$. When $Xaa_1$ or the amino-terminal amino acid of the peptide of the invention (e.g., $Xaa_2$ or $Xaa_3$) is Lys or Arg, the peptide has a trypsin cleavage site that is located at a position where cleavage will liberate portion of the peptide amino-terminal to $Xaa_1$ along with $Xaa_1$, $Xaa_2$ or $Xaa_3$). Thus, for example, if the peptide includes an analgesic peptide amino-terminal to $Xaa_1$, the peptide will be liberated in the digestive tract upon exposure to the appropriate protease. Among the analgesic peptides which can be included in the peptide are: AspPhe, endomorphin-1, endomorphin-2, nocistatin, dalargin, lupron, ziconotide, and substance p and other analgesic peptides described herein.

The peptides can linked, e.g., covalently linked to any of a variety of other peptides or compounds, including analgesic peptides or compounds.

Amino acid, non-amino acid, peptide and non-peptide spacers can be interposed between peptides of the invention and a peptide that has some other biological function, e.g., an analgesic peptide or a peptide used to treat obesity. The linker can be one that is cleaved from the flanking peptides in vivo or one that remains linked to the flanking peptides in vivo. For example, glycine, beta-alanine, glycyl-glycine, glycyl-beta-alanine, gamma-aminobutyric acid, 6-aminocaproic acid, L-phenylalanine, L-tryptophan and glycil-L-valil-L-phenylalanine can be used as spacers (Chaltin et al. 2003 Helvetica Chimica Acta 86:533-547; Caliceti et al. 1993 FARMCO 48:919-32) as can polyethylene glycols (Butterworth et al. 1987 J. Med. Chem 30:1295-302) and maleimide derivatives (King et al. 2002 Tetrahedron Lett. 43:1987-1990). Various other linkers are described in the literature (Nestler 1996 Molecular Diversity 2:35-42; Finn et al. 1984 Biochemistry 23:2554-8; Cook et al. 1994 Tetrahedron Lett. 35:6777-80; Brokx et al. 2002 Journal of Controlled Release 78:115-123; Griffin et al. 2003 J. Am. Chem. Soc. 125:6517-6531; Robinson et al. 1998 Proc. Natl. Acad. Sci. USA 95:5929-5934.

The peptides of the invention can be attached to one, two or more different moieties each providing the same or different functions. For example, the peptide can be linked to a molecule that is an analgesic and to a peptide that is used to treat obesity. The peptide and various moieties can be ordered in various ways. For example, a peptide of the invention can have an analgesic peptide linked to its amino terminus and an anti-obesity peptide linked to its carboxy terminus. The additional moieties can be directly covalently bonded to the peptide or can be bonded via linkers.

The peptides of the invention can be a cyclic peptide or a linear peptide. In addition, multiple copies of the same peptide can be incorporated into a single cyclic or linear peptide.

The peptides can include the amino acid sequence of a peptide that occurs naturally in a vertebrate (e.g., mammalian) species or in a bacterial species. In addition, the peptides can be partially or completely non-naturally occurring peptides. Also within the invention are peptidomimetics corresponding to the peptides of the invention.

When fully folded, disulfide bonds are present between the first and third cysteines and between the second and fourth cysteines, e.g., there is a disulfide bond between $Cys_4$ and $Cys_{12}$ and a disulfide bond between $Xaa_7$ and $Xaa_{15}$ (when $Xaa_7$ is a Cys and $Xaa_{15}$ is a Cys).

In some embodiments, the peptide has only one disulfide bond, e.g., between the first and third cysteines (i.e., $Cys_4$ and $Cys_{12}$; corresponds to the first and second cysteines when $Xaa_7$ is other than Cys). In certain embodiments one or more Cys can be replaced by Mpt (mercaptoproline) or Pen (penicillamine) or Dpr (diaminopropionic acid) or some other amino acid that can covalently link to another amino acid (e.g., Cys, Mpt, Pen or Dpr).

In some embodiments, one or both members of a pair of Cys residues which normally form a disulfide bond can be replaced by homocysteine, penicillamine, 3-mercaptoproline (Kolodziej et al. 1996 Int J Pept Protein Res 48:274); β, β-dimethylcysteine (Hunt et al. 1993 Int J Pept Protein Res 42:249) or diaminopropionic acid (Smith et al. 1978 J Med Chem 21:117) to form alternative internal cross-links at the positions of the normal disulfide bonds.

In addition, one or more disulfide bonds can be replaced by alternative covalent cross-links, e.g., an amide linkage (—CH2CH(O)NHCH2— or —CH2NHCH(O)CH2—), an ester linkage, a thioester linkage, a lactam bridge, a carbamoyl linkage, a urea linkage, a thiourea linkage, a phosphonate ester linkage, an alkyl linkage (—CH2CH2CH2CH2—), an alkenyl linkage(—CH2CH=CHCH2—), an ether linkage (—CH2CH2OCH2— or —CH2OCH2CH2—), a thioether linkage (—CH2CH2SCH2— or —CH2SCH2CH2—), an amine linkage (—CH2CH2NHCH2— or —CH2NHCH2CH2—) or a thioamide linkage (—CH2CH(S)HNHCH2— or —CH2NHCH(S)CH2—). For example, Ledu et al. (Proc Nat'l Acad. Sci. 100:11263-78, 2003) describe methods for preparing lactam and amide cross-links. Schafmeister et al. (J. Am. Chem. Soc. 122:5891, 2000) describes stable, hydrocarbon cross-links. Hydrocarbon cross links can be produced via metathesis (or methathesis followed by hydrogenation in the case of saturated hydrocarbons cross-links) using one or another of the Grubbs catalysts (available from Materia, Inc. and Sigma-Aldrich and described, for example, in U.S. Pat. Nos. 5,831,108 and 6,111,121). In some cases, the generation of such alternative cross-links requires replacing the Cys residues with other residues such as Lys or Glu or non-naturally occurring amino acids. In addition the lactam, amide and hydrocarbon cross-links can be used to stabilize the peptide even if they link amino acids at postions other than those occupied by Cys. Such cross-links can occur between two amino acids that are separated by two amino acids or between two amino acids that are separated by six amino acids (see, e.g., Schafmeister et al. (J. Am. Chem. Soc. 122:5891, 2000)).

In certain embodiments, one or more amino acids can be replaced by a non-naturally occurring amino acid or a naturally or non-naturally occurring amino acid analog. There are many amino acids beyond the standard 20. Some are naturally-occurring others are not (see, for example, Hunt, The Non-Protein Amino Acids: In Chemistry and Biochemistry of the Amino Acids, Barrett, Chapman and Hall, 1985). For example, an aromatic amino acid can be replaced by 3,4-dihydroxy-L-phenylalanine, 3-iodo-L-tyrosine, triiodothyronine, L-thyroxine, phenylglycine (Phg) or nor-tyrosine (norTyr). Phg and norTyr and other amino acids including Phe and Tyr can be substituted by, e.g., a halogen, —CH3, —OH, —CH$_2$NH$_3$, —C(O)H, —CH$_2$CH$_3$, —CN, —CH$_2$CH$_2$CH$_3$, —SH, or another group. Any amino acid can be substituted by the D-form of the amino acid.

With regard to non-naturally occurring amino acids or a naturally and non-naturally occurring amino acid analogs, a number of substitutions in the peptide and agonists of the invention are possible alone or in combination.

For example, glutamine residues can be substituted with gamma-Hydroxy-Glu or gamma-Carboxy-Glu. Tyrosine residues can be substituted with an alpha substituted amino acid such as L-alpha-methylphenylalanine or by analogues such as: 3-Amino-Tyr; Tyr(CH3); Tyr(PO3(CH3)2); Tyr (SO3H); beta-Cyclohexyl-Ala; beta-(1-Cyclopentenyl)-Ala; beta-Cyclopentyl-Ala; beta-Cyclopropyl-Ala; beta-Quinolyl-Ala; beta-(2-Thiazolyl)-Ala; beta-(Triazole-1-yl)-Ala; beta-(2-Pyridyl)-Ala; beta-(3-Pyridyl)-Ala; Amino-Phe; Fluoro-Phe; Cyclohexyl-Gly; tBu-Gly; beta-(3-benzothienyl)-Ala; beta-(2-thienyl)-Ala; 5-Methyl-Trp; and 4-Methyl-Trp. Proline residues can be substituted with homopro (L-pipecolic acid); hydroxy-Pro; 3,4-Dehydro-Pro; 4-fluoro-Pro; or alpha-methyl-Pro or an N(alpha)-C(alpha) cyclized amino acid analogues with the structure:

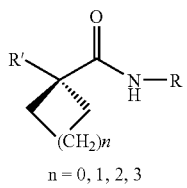

n = 0, 1, 2, 3

Alanine residues can be substituted with alpha-substituted or N-methylated amino acid such as alpha-amino isobutyric acid (aib), L/D-alpha-ethylalanine (L/D-isovaline), L/D-methylvaline, or L/D-alpha-methylleucine or a non-natural amino acid such as beta-fluoro-Ala. Alanine can also substituted with:

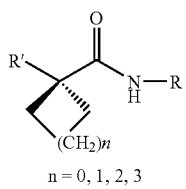

n = 0, 1, 2, 3

Glycine residues can be substituted with alpha-amino isobutyric acid (aib) or L/D-alpha-ethylalanine (L/D-isovaline).

Further examples of unnatural amino acids include: an unnatural analogue of tyrosine; an unnatural analogue of glutamine; an unnatural analogue of phenylalanine; an unnatural analogue of serine; an unnatural analogue of threonine; an alkyl, aryl, acyl, azido, cyano, halo, hydrazine, hydrazide, hydroxyl, alkenyl, alkynl, ether, thiol, sulfonyl, seleno, ester, thioacid, borate, boronate, phospho, phosphono, phosphine, heterocyclic, enone, imine, aldehyde, hydroxylamine, keto, or amino substituted amino acid, or any combination thereof; an amino acid with a photoactivatable cross-linker; a spin-labeled amino acid; a fluorescent amino acid; an amino acid with a novel functional group; an amino acid that covalently or noncovalently interacts with another molecule; a metal binding amino acid; a metal-containing amino acid; a radioactive amino acid; a photocaged and/or photoisomerizable amino acid; a biotin or biotin-analogue containing amino acid; a glycosylated or carbohydrate modified amino acid; a keto containing amino acid; amino acids comprising polyethylene glycol or polyether; a heavy atom substituted amino acid (e.g., an amino acid containing deuterium, tritium, $^{13}$C, $^{15}$N, or $^{18}$O); a chemically cleavable or photocleavable amino acid; an amino acid with an elongated side chain; an amino acid containing a toxic group; a sugar substituted amino acid, e.g., a sugar substituted serine or the like; a carbon-linked sugar-containing amino acid; a redox-active amino acid; an α-hydroxy containing acid; an amino thio acid containing amino acid; an α,α disubstituted amino acid; a β-amino acid; a cyclic amino acid other than proline; an O-methyl-L-tyrosine; an L-3-(2-naphthyl)alanine; a 3-methyl-phenylalanine; a p-acetyl-L-phenylalanine; an 0-4-allyl-L-tyrosine; a 4-propyl-L-tyrosine; a tri-O-acetyl-GlcNAcβ-serine; an L-Dopa; a fluorinated phenylalanine; an isopropyl-L-phenylalanine; a p-azido-L-phenylalanine; a p-acyl-L-phenylalanine; a p-benzoyl-L-phenylalanine; an L-phosphoserine; a phosphonoserine; a phosphonotyrosine; a p-iodo-phenylalanine; a 4-fluorophenylglycine; a p-bromophenylalanine; a p-amino-L-phenylalanine; an isopropyl-L-phenylalanine; L-3-(2-naphthyl)alanine; an amino-, isopropyl-, or O-allyl-containing phenylalanine analogue; a dopa, O-methyl-L-tyrosine; a glycosylated amino acid; a p-(propargyloxy)phenylalanine, dimethyl-Lysine, hydroxyproline, mercaptopropionic acid, methyl-lysine, 3-nitro-tyrosine, norleucine, pyro-glutamic acid, Z (Carbobenzoxyl), ε-Acetyl-Lysine, β-alanine, aminobenzoyl derivative, aminobutyric acid (Abu), citrulline, aminohexanoic acid, aminoisobutyric acid, cyclohexylalanine, d-cyclohexylalanine, hydroxyproline, nitro-arginine, nitro-phenylalanine, nitro-tyrosine, norvaline, octahydroindole carboxylate, ornithine, penicillamine, tetrahydroisoquinoline, acetamidomethyl protected amino acids and a pegylated amino acid. Further examples of unnatural amino acids can be found in U.S. 20030108885, U.S. 20030082575, and the references cited therein.

In some embodiments, an amino acid can be replaced by a naturally-occurring, non-essential amino acid, e.g., taurine.

Methods to manufacture peptides containing unnatural amino acids can be found in, for example, U.S. 20030108885, U.S. 20030082575, Deiters et al., J Am Chem Soc. (2003) 125:11782-3, Chin et al., Science (2003) 301:964-7, and the references cited therein.

Peptides that include non-natural amino acids can also be prepared using the methods described in WO02086075.

The peptides of the invention can have one or more conventional peptide bonds replaced by an alternative bond. Such replacements can increase the stability of the peptide. For example, replacement of the peptide bond between a residue amino terminal to an aromatic residue (e.g. Tyr, Phe, Trp) with an alternative bond can reduce cleavage by carboxy peptidases and may increase half-life in the digestive tract. Bonds that can replace peptide bonds include: a retro-inverso bonds (C(O)—NH instead of NH—C(O)); a reduced amide bond (NH—CH2); a thiomethylene bond (S—CH2 or CH2—S); an oxomethylene bond (O—CH2 or CH2—O); an ethylene bond (CH2—CH2); a thioamide bond (C(S)—NH); a trans-olefine bond (CH=CH); an fluoro substituted trans-olefine bond (CF=CH); a ketomethylene bond (C(O)—CHR or CHR—C(O) wherein R is H or CH3; and a fluoro-ketomethylene bond (C(O)—CFR or CFR—C(O) wherein R is H or F or CH3.

The peptides of the invention can be modified using standard modifications. Modifications may occur at the amino (N—), carboxy (C—) terminus, internally or a combination of any of the preceeding. In one aspect of the invention, there may be more than one type of modification on the peptide. Modifications include but are not limited to: acetylation, amidation, biotinylation, cinnamoylation, farnesylation, formylation, myristoylation, palmitoylation, phosphorylation (Ser, Tyr or Thr), stearoylation, succinylation, sulfurylation and cyclisation (via disulfide bridges or amide cyclisation), and modification by Cy3 or Cy5. The peptides of the invention may also be modified by 2,4-dinitrophenyl (DNP), DNP-lysin, modification by 7-Amino-4-methyl-coumarin (AMC), flourescein, NBD (7-Nitrobenz-2-Oxa-1,3-Diazole), p-nitro-anilide, rhodamine B, EDANS (5-((2-aminoethyl)amino) naphthalene-1-sulfonic acid), dabcyl, dabsyl, dansyl, texas red, FMOC, and Tamra (Tetramethylrhodamine). The peptides of the invention may also be conjugated to, for example, polyethylene glycol (PEG); alkyl groups (e.g., C1-C20 straight or branched alkyl groups); fatty acid radicals; combinations of PEG, alkyl groups and fatty acid radicals (see U.S. Pat. No. 6,309,633; Soltero et al., 2001 Innovations in Pharmaceutical Technology 106-110); BSA and KLH (Keyhole Limpet Hemocyanin).

The peptides and agonists of the invention can be chemically modified to increase therapeutic activity by synthetically adding sugar moieties (WO 88/02756; WO 89/09786; DE 3910667 A1, EP 0 374 089 A2; and U.S. Pat. No. 4,861,755), adding cationic anchors (EP0363589), lipid moieties (WO91/09837; U.S. Pat. No. 4,837,303) or the substituents described as compounds I, II, and III in U.S. Pat. No. 5,552,520.

The invention also features a purified polypeptide comprising, consisting of or consisting essentially of the amino acid sequence: $Xaa_1$ $Xaa_2$ $Xaa_3$ $Cys_4$ $Xaa_5$ $Xaa_6$ $Xaa_7$ $Xaa_8$ $Xaa_9$ $Xaa_{10}$ $Xaa_{11}$ $Cys_{12}$ $Xaa_{13}$ $Xaa_{14}$ $Xaa_{15}$ $Xaa_{16}$ (SEQ ID NO:1) wherein:

$Xaa_1$ is any amino acid or is missing;
$Xaa_2$ is any amino acid or is missing;
$Xaa_3$ is any amino acid or is missing;
$Xaa_5$ is Glu;
$Xaa_6$ is Tyr, Trp, Phe or Leu;
$Xaa_7$ is Cys;
$Xaa_8$ is any of the 20 naturally-occurring amino acids other than Cys or is missing;
$Xaa_9$ is any of the 20 naturally-occurring amino acids;
$Xaa_{10}$ is Pro or Gly;
$Xaa_{11}$ is any of the 20 naturally-occurring amino acids;
$Xaa_{13}$ is Thr, Val or Gly;
$Xaa_{14}$ is Gly or Ala;
$Xaa_{15}$ is Cys; and
$Xaa_{16}$ is any of the 20 naturally-occurring amino acids or is missing.

In various embodiments: $Xaa_9$ is Asn; $Xaa_{11}$ is Ala or Thr; $Xaa_8$ is missing; and $Xaa_{16}$ is Tyr.

In other embodiments $Xaa_4$ is immediately preceded by an amino acid sequence seleted from: Ser His Thr; Pro Ser Thr; Thr; Pro Asp Pro; Ile Ala Glu Asp Ser His Thr (SEQ ID NO:8604); Ile Ala Gln Asp Pro Ser Thr (SEQ ID NO:8605); Ala Asn Thr; Asn Thr; Asp Pro Asn Thr (SEQ ID NO:8606); Lys Asn Thr; Pro Asn Thr; Ile Ala Gln Asp Pro Asn Thr (SEQ ID NO:8607); Lys Pro Asn Thr (SEQ ID NO:8608); Asp Pro Gly Thr (SEQ ID NO:8609); Glu Asp Pro Gly Thr (SEQ ID NO:8610); Pro Gly Thr; Pro Ala Thr; Val Ala Ala Arg Ala Asp Leu (SEQ ID NO:8611); Gly Asp Asp; Asn Asp Glu; Gln Glu Asp; Asn Asp Asp; Arg Thr Ile Ala Asn Asp Asp (SEQ ID NO:8612); Thr Ile Ala Asn Asp Asp (SEQ ID NO:8613); Asp Asp; Arg Thr Met Asp Asn Asp Glu (SEQ ID NO:8614); Arg Thr Ile Ala Gly Asp Asp (SEQ ID NO:8615); Arg Thr Ile Ala Asn Asp (SEQ ID NO:8616); Asp; Glu Asp; Arg Ser Ile Ser Gln Glu Asp (SEQ ID NO:8617); Thr Asp Glu; Arg Thr Ile Ala Thr Asp Glu (SEQ ID NO:8618); Glu; Ile Ile Thr Pro Pro Asp Pro (SEQ ID NO:8619); Gln Glu Leu; Lys Asp Asp; Gln Glu Glu; Arg Tyr Ile Asn Gln Glu Glu (SEQ ID NO:8620); Ala Ser Ser Tyr Ala Ser (SEQ ID NO:8621); and Thr Ser Ser Tyr Ala Ser (SEQ ID NO:8622).

The invention further features a purified polypeptide comprising, consisting of or consisting essentially the amino acid sequence: $Xaa_1$ $Xaa_2$ $Xaa_3$ $Cys_4$ $Xaa_5$ $Xaa_6$ $Xaa_7$ $Xaa_8$ $Xaa_9$ $Xaa_{10}$ $Xaa_{11}$ $Cys_{12}$ $Xaa_{13}$ $Xaa_{14}$ $Xaa_{15}$ $Xaa_{16}$ (SEQ ID NO:1) wherein:

$Xaa_1$ is: a) Ser, Asn, Tyr, Ala, Gln, Pro, Lys, Gly, or Thr, or is missing; b) preceded by Lys or Tyr; c) any amino acid; d) missing; e) any amino acid other than Cys; or f) Lys or Arg;

$Xaa_2$ is: a) His, Asp, Glu, Ala, Ser, Asn, Gly, or is missing; b) His, Asp, Glu, Ala, Ser, Asn, Gly, Pro or is missing; c) Asp, Glu, any amino acid or is missing; d) Asp or Glu; e) any amino acid other than Cys; e) Glu; f) missing; g) Trp, Tyr or Phe; or h) Lys or Arg;

$Xaa_3$ is: a) Thr, Asp, Ser, Glu, Pro, Val or Leu; Asp or Glu; b) any amino acid other than Cys; c) Glu; d) Thr; e) Thr, Asp, Ser, Glu, Pro, Val or Leu or is missing; f) Trp, Tyr or Phe; or g) Lys or Arg;

$Xaa_4$ is: a) Cys, Mpt (mercaptoproline), Pen (penicillamine), Dpr (diaminopropionic acid), Asp, or Glu;

$Xaa_5$ is: a) any amino acid; b) Glu, Asp, Gln, Gly or Pro; c) Glu; d) Glu or Asp; e) Asp, Ile or Glu; f) any amino acid; or g) any amino acid other than Cys;

$Xaa_6$ is: a) Leu, Ile, Val, Ala, Lys, Arg, Trp, Tyr or Phe; b) Leu, Ile, Val, Lys, Arg, Trp, Tyr or Phe; Leu, Ile, Lys, Arg, Trp, Tyr or Phe; c) Leu, Ile, Val, Trp, Tyr or Phe; d) Trp, Tyr, Phe or Leu; e) Leu, Ile or Val; f) Ile, Trp or Leu; g) Trp, Tyr or Phe; h) Ile or Leu; i) Tyr; j) any amino acid; k) any amino acid except Leu; 1) any natural or non-natural aromatic amino acid; or m) any amino acid other than Cys;

$Xaa_7$ is: a) Cys, Ser, or Tyr; Cys; b) Cys, Mpt (mercaptoproline), Pen (penicillamine), Dpr (diaminopropionic acid), Asp or Glu; c) Ser; or d) an amino acid other than Cys;

$Xaa_8$ is: a) Ala, Val, or Ile; b) Ala, Val, Thr, Ile, Met or is missing; c) any amino acid; d) Val; e) any amino acid other than Cys; or f) missing;

$Xaa_9$ is: a) any amino acid; b) any amino acid other than Phe and Tyr; c) any amino acid other than Phe, Tyr, and Trp; d) any amino acid other than Phe, Tyr, Trp, Ile, Leu and Val; e) any amino acid other than Phe, Tyr, Trp, Ile, Leu, Val, and His; f) any amino acid other than Gln; g) any amino acid other than Lys, Arg, Phe, Tyr, and Trp; h) any amino acid other than Lys, Arg, Phe, Tyr, Trp, Ile, Leu and Val; i) any amino acid other than Lys, Arg, Phe, Tyr, Trp, Ile, Leu, Val, and His; j) any non-aromatic amino acid; k) missing; l) Phe, Tyr, Asn, or Trp; m) Asn, Tyr, Asp or Ala; n) Asn, Gln, or Tyr; o) Phe or Tyr; p) Asn; or q) any amino acid other than Cys;

$Xaa_{10}$ is: a) Ala, Pro or Gly; b) Pro or Gly; c) Pro; d) Ala, Val, Met, Thr or Ile; e) any amino acid; f) Val; g) Val or Pro; h) Ala or Val; i) any amino acid other than Cys; j) Pro; or k) Gly;

$Xaa_{11}$ is: a) any amino acid; b) Ala, Leu, Ser, Gly, Val, Glu, Gln, Ile, Leu, Lys, Arg, or Asp; c) Ala or Gly; d) Ala; e)

Ala or Val; f) any amino acid; g) Ala or Aib (alpha-aminoisobutyric acid); h) any amino acid other than Cys; i) Ala or Thr; or j) Thr.

$Xaa_{12}$ is: a) Cys, Mpt (mercaptoproline), Pen (penicillamine), Dpr (diaminopropionic acid), Asp, or Glu; or b) any amino acid other than Cys;

$Xaa_{13}$ is: a) Thr, Ala, Asn, Lys, Arg, or Trp; b) Thr, Ala, Lys, Arg, or Trp; c) any amino acid; d) any non-aromatic amino acid; e) Thr, Ala, or Trp; f) Trp, Tyr or Phe; g) Thr or Ala; h) any amino acid; i) Thr; j) any amino acid other than Cys; k) Thr, Val, or Gly; l) Thr or Val, m) Thr or Gly, n) Val or Thr; o) Val; p) Thr; or q) Gly;

$Xaa_{14}$ is: a) Gly, Pro or Ala; b) Gly; c) any amino acid; d) Gly, Ala or Ser; e) Gly or Ala; f) any amino acid other than Cys; or g) Ala;

$Xaa_{15}$ is: a) Cys, Tyr or is missing; b) Cys; c) Cys, Mpt (mercaptoproline), Pen (penicillamine), Dpr (diaminopropionic acid), Asp, Glu; or d) any amino acid other than Cys or is missing; and $Xaa_{16}$ is: a) Trp, Tyr, Phe, Asn, Ile, Val, His or Leu; b) Trp, Tyr, Phe, Asn or Leu; c) Trp, Tyr, Phe or Leu; d) Trp, Tyr, or Phe; e) Leu, Ile or Val; f) His, Leu or Ser; g) Tyr or Leu; Lys or Arg; h) His; i) any amino acid, j) Leu, or missing; k) Trp, Tyr, Phe, Lys, Arg or is missing; l) missing; m) any amino acid other than Cys; or n) Tyr.

Also featured is purified polypeptide comprising, consisting of or consisting essentially of the amino acid sequence: $Xaa_1$ $Xaa_2$ $Xaa_3$ $Xaa_4$ $Xaa_5$ $Xaa_6$ $Xaa_7$ $Xaa_8$ $Xaa_9$ $Xaa_{10}$ $Xaa_{11}$ $Xaa_{12}$ $Xaa_{13}$ $Xaa_{14}$ $Xaa_{15}$ $Xaa_{16}$ (SEQ ID NO:1) wherein:

$Xaa_1$ is any amino acid or is missing;
$Xaa_2$ is any amino acid or is missing;
$Xaa_3$ is any amino acid or is missing;
$Xaa_4$ is Cys, Mpt (mercaptoproline), Pen (penicillamine), Dpr (diaminopropionic acid), Asp or Glu;
$Xaa_5$ is Glu;
$Xaa_6$ is Tyr, Trp, Phe or Leu;
$Xaa_7$ is Cys, Mpt (mercaptoproline), Pen (penicillamine), Dpr (diaminopropionic acid), Asp or Glu;
$Xaa_8$ is any amino acid other than Cys or is missing;
$Xaa_9$ is any amino acid;
$Xaa_{10}$ is Pro or Gly;
$Xaa_{11}$ is any amino acid;
$Xaa_{12}$ is Cys, Mpt (mercaptoproline), Pen (penicillamine), Dpr (diaminopropionic acid), Asp or Glu;
$Xaa_{13}$ is Thr, Val or Gly;
$Xaa_{14}$ is Gly or Ala;
$Xaa_{15}$ is Cys, Mpt (mercaptoproline), Pen (penicillamine), Dpr (diaminopropionic acid), Asp or Glu; and
$Xaa_{16}$ is any amino acid or is missing.

The invention also features peptides which may include one or more of the peptide modifications, one or more non-natural amino acid or amino acid analogs, one or more of the disulfide bond alternatives or one or more of the alternative peptide bonds described herein.

The various peptides can be present with a counterion. Useful counterions include salts of: acetate, benzenesulfonate, benzoate, calcium edetate, camsylate, carbonate, citrate, edetate (EDTA), edisylate, embonate, esylate, fumarate, gluceptate, gluconate, glutamate, glycollylarsanilate, hexylresorcinate, iodide, bromide, chloride, hydroxynaphthoate, isethionate, lactate, lactobionate, estolate, maleate, malate, mandelate, mesylate, mucate, napsylate, nitrate, pantothenate, phosphate, salicylate, stearate, succinate, sulfate, tartarate, theoclate, acetamidobenzoate, adipate, alginate, aminosalicylate, anhydromethylenecitrate, ascorbate, aspartate, camphorate, caprate, caproate, caprylate, cinnamate, cyclamate, dichloroacetate, formate, gentisate, glucuronate, glycerophosphate, glycolate, hippurate, fluoride, malonate, napadisylate, nicotinate, oleate, orotate, oxalate, oxoglutarate, palmitate, pectinate, pectinate polymer, phenylethylbarbiturate, picrate, propionate, pidolate, sebacate, rhodanide, tosylate, and tannate.

In a second aspect, the invention also features a therapeutic or prophylactic method comprising administering a composition comprising a purified peptide comprising, consisting essentially or consisting of the amino acid sequence of SEQ ID NO:1 or another peptide or agonist of the invention. For the treatment of gastrointestinal disorders, the peptide can be administered orally, by rectal suppository or parenterally.

In various embodiments, the patient is suffering from a gastrointestinal disorder; the patient is suffering from a disorder selected from the group consisting of: a gastrointestinal motility disorder, irritable bowel syndrome, a functional gastrointestinal disorder, gastroesophageal reflux disease, duodenogastric reflux, functional heartburn, dyspepsia, functional dyspepsia, nonulcer dyspepsia, gastroparesis, chronic intestinal pseudo-obstruction, colonic pseudo-obstruction, obesity, congestive heart failure, or benign prostatic hyperplasia; the composition is administered orally; the peptide comprises 150, 140, 130, 120, 110, 100, 90, 80, 70, 60, 50, 40, or 30 or fewer amino acids. In other embodiments, the peptide comprises 20 or fewer amino acids, and the peptide comprises no more than 5 amino acids prior to $Cys_4$. In other embodiments the peptide comprises no more than 20, 15, 10, or 5 peptides subsequent to $Cys_{15}$. In certain embodiments $Xaa_{16}$ is a chymotrypsin or trypsin cleavage site and an analgesic peptide is present immediately following $Xaa_{16}$.

Among the useful peptides are those comprising, consisting of or consisting essentially of any of the following amino acid sequences:

```
SHTCEICAFAACAGC  (opossum guanylin);                          (SEQ ID NO:40)

PGTCEICAYAACTGC  (human guanylin);                            (SEQ ID NO:4)

PSTCEICAYAACAGC  (pig guanylin);                              (SEQ ID NO:41)

PNTCEICAYAACTGC  (rat guanylin);                              (SEQ ID NO:42

PDPCEICANAACTGCL (European eel guanylin, inferred);           (SEQ ID NO:43)

NDDCELCVNVACTGCL (human uroguanylin);                         (SEQ ID NO:44)

QEECELCINMACTGY  (opossum lymphoguanylin);                    (SEQ ID NO:45)

GDDCELCVNVACTGCS (pig uroguanylin);                           (SEQ ID NO:46)
```

-continued

| | |
|---|---|
| NDECELCVNIACTGC (guinea pig uroguanylin); | (SEQ ID NO:47) |
| TDECELCINVACTGC (rat uroguanylin); | (SEQ ID NO:48) |
| QEDCELCINVACTGC (opossum uroguanylin); | (SEQ ID NO:49) |
| MPSTQYIRRPASSYASCIWCTTACASCHGRTTKPSLAT (EAST 1); | (SEQ ID NO:50) |
| MPSTQYIRRPASSYASCIWCATACASCHGRTTKPSLAT; | (SEQ ID NO:51) |
| MPSTQYIRRPTSSYASCIWCATACASCHGRTTKPSLAT; | (SEQ ID NO:52) |
| MPSTQYIRRPTSSYASCIWCATVCASCHGRTTKPSLAT; | (SEQ ID NO:53) |
| MPSTQYIRRPASSYASCIWYATACASCHGRTTEPSLAT; | (SEQ ID NO:54) |
| QEECELSINMACTGY (opossum lymphoguanylin analog); | (SEQ ID NO:55) |
| YDECEICMFAACTGC (Japanese eel guanylin); | (SEQ ID NO:56) |
| VCEICAFAACTGC (Zebrafish guanylin, inferred); | (SEQ ID NO:57) |
| ADLCEICAFAACTGCL (Japanese eel renoguanylin, inferred); | (SEQ ID NO:58) |
| PGTCEICAYAACTGCL; | (SEQ ID NO:59) |
| PGTCEICAYAACTGCLKK; | (SEQ ID NO:60) |
| PNTCEICAYAACTGCKKKKKK; | (SEQ ID NO:61) |
| PNTCEICAYAACTGCD; | (SEQ ID NO:62) |
| PNTCEICAYAACTGCDK; | (SEQ ID NO:63) |
| YPNTCEICAYAACTGC; | (SEQ ID NO:64) |
| KNTCEICAYAACTGC; | (SEQ ID NO:65) |
| KPNTCEICAYAACTGC; | (SEQ ID NO:66) |
| EDPGTCEICAYAACTGC; | (SEQ ID NO:67) |
| VTVQDG NFSFSLESVK KLKDLQEPQE PRVGKLRNFA PIPGEPVVPI LCSNPNFPEE LKPLCKEPNA QEILQRLEEIAEDPGTCEICAYAACTGC; | (SEQ ID NO:68) |
| DPGTCEICAYAACTGC; | (SEQ ID NO:69) |
| MNAFLLSALC LLGAWAALAG GVTVQDGNFS FSLESVKKLK DLQEPQEPRV GKLRNFAPIP GEPVVPILCS NPNFPEELKP LCKEPNAQEI LQRLEEIAED PGTCEICAYAACTGC; | (SEQ ID NO:70) |
| MNAFLLFALC LLGAWAALAG GVTVQDGNFS FSLEPRVGKL RNFAPIPGEP VVPILCSNPN FPEELKPLCK EPNAQEILQR LEEIAEDPGTCEICAYAACTGC; | (SEQ ID NO:71) |
| TGSMNAFLLF ALCLLGAWAA LAGGVTVQDG NFSFSLEPRV GKLRNFAPIP GEPVVPILCS NPNFPEELKP LCKEPNAQEI LQRLEEIAEDPGTCEICAYAACTGCLEG; | (SEQ ID NO:72) |
| NDECELCVNVACTGCL; | (SEQ ID NO:73) |
| ECELCVNVACTGCL; | (SEQ ID NO:74) |
| EDCELCINVACTGC; | (SEQ ID NO:75) |
| NDDCELCVACTGCL; | (SEQ ID NO:76) |
| FKTLRTIANDDCELCVNVACTGCL; | (SEQ ID NO:77) |
| FKTLRTIANDDCLCVNVACTGCL; | (SEQ ID NO:78) |
| DDCELCVNVACTGCL; | (SEQ ID NO:79) |
| DCELCVNVACTGCL; | (SEQ ID NO:80) |
| CELCVNVACTGCL; | (SEQ ID NO:81) |

-continued

```
KDDCELCVNVACTGCL;                           (SEQ ID NO:82)

PNTCEICANPACTGC;                            (SEQ ID NO.83)

NDDCELCVNVACTGCS (cow uroguanylin);         (SEQ ID NO:8626)

PDVCDVCAFAACSGC (Xenopus guanylin);         (SEQ ID NO.8627)

LDLCEICAFAACTGC (Fugu guanylin);            (SEQ ID NO.8628)

VDVCEICAFAACTGC (Zebrafish guanylin);       (SEQ ID NO.8629)

LDICEICAFAACTGC (Pufferfish guanylin);      (SEQ ID NO.8630)

ADLCEICANAACSGCF (chicken uroguanylin);     (SEQ ID NO.8631)

LDPCEICANPSCFGCLN (fugu uroguanylin);       (SEQ ID NO.8632)

IDPCEICANVACTGC (eel uroguanylin);          (SEQ ID NO.8633)

SDPCEICANPSCFGCLD (killifish uroguanylin);  (SEQ ID NO.8634)
```

The peptides can include the amino acid sequence of a peptide that occurs naturally in a vertebrate (e.g., mammalian) species or in a bacterial species. In addition, the peptides can be partially or completely non-naturally occurring peptides.

In a third aspect, the invention features a method for treating a patient suffering from constipation, the method comprising administering a composition comprising a peptide comprising, consisting essentially or consisting of the amino acid sequence of SEQ ID NO:1 or another peptide or agonist of the invention. Clinically accepted criteria that define constipation range from the frequency of bowel movements, the consistency of feces and the ease of bowel movement. One common definition of constipation is less than three bowel movements per week. Other definitions include abnormally hard stools or defecation that requires excessive straining (Schiller 2001 Aliment Pharmacol Ther 15:749-763). Constipation may be idiopathic (functional constipation or slow transit constipation) or secondary to other causes including neurologic, metabolic or endocrine disorders. These disorders include diabetes mellitus, hypothyroidism, hyperthyroidism, hypocalcaemia, Multiple sclerosis, Parkinson's disease, spinal cord lesions, Neurofibromatosis, autonomic neuropathy, Chagas disease, Hirschsprung disease and cystic fibrosis. Constipation may also be the result of surgery or due to the use of drugs such as analgesics (like opioids), antihypertensives, anticonvulsants, antidepressants, antispasmodics and antipsychotics.

In various embodiments, the constipation is associated with use of a therapeutic agent; the constipation is associated with a neuropathic disorder; the constipation is post-surgical constipation; the constipation is associated with a gastrointestinal disorder; the constipation is idiopathic (functional constipation or slow transit constipation); the constipation is associated with neuropathic, metabolic or endocrine disorder (e.g., diabetes mellitus, hypothyroidism, hyperthyroidism, hypocalcaemia, Multiple Sclerosis, Parkinson's disease, spinal cord lesions, neurofibromatosis, autonomic neuropathy, Chagas disease, Hirschsprung disease or cystic fibrosis). Constipation may also be the result of surgery or due to the use of drugs such as analgesics (e.g., opioids), antihypertensives, anticonvulsants, antidepressants, antispasmodics and antipsychotics.

In a fourth aspect, the invention features a method for treating a patient suffering from a gastrointestinal disorder, the method comprising administering to the patient a composition comprising a purified peptide comprising, consisting essentially of or consisting of the amino acid sequence of SEQ ID NO: 1 or another peptide or agonist of the invention.

In various embodiments, the patient is suffering from a gastrointestinal disorder; the patient is suffering from a disorder selected from the group consisting of: a gastrointestinal motility disorder, irritable bowel syndrome, a functional gastrointestinal disorder, gastroesophageal reflux disease, functional heartburn, dyspepsia, functional dyspepsia, nonulcer dyspepsia, gastroparesis, chronic intestinal pseudo-obstruction, colonic pseudo-obstruction; Crohn's disease, ulcerative colitis, Inflammatory bowel disease, colonic pseudo-obstruction, obesity, congestive heart failure, and benign prostatic hyperplasia.

In a fifth aspect, the invention features a method for increasing gastrointestinal motility in a patient, the method comprising administering to the patient a composition comprising a purified peptide comprising, consisting essentially of or consisting of the amino acid sequence of SEQ ID NO:1 or another peptide or agonist of the invention.

In a sixth aspect, the invention features a method for decreasing gastrointestinal pain or visceral pain in a patient, the method comprising administering to the patient a composition comprising a purified peptide comprising, consisting essentially of or consisting of the amino acid sequence of SEQ ID NO:1 or another peptide or agonist of the invention.

In a seventh aspect, the invention features a method for increasing the activity of an intestinal guanylate cyclase (GC-C) receptor in a patient, the method comprising administering to the patient a composition comprising a purified peptide comprising, consisting essentially of or consisting of the amino acid sequence of SEQ ID NO:1 or another peptide or agonist of the invention.

In an eighth aspect, the invention features an isolated nucleic acid molecule comprising a nucleotide sequence encoding a peptide comprising, consisting essentially of or consisting of the amino acid sequence of SEQ ID NO:1 or another peptide or agonist of the invention.

In a ninth aspect, the invention features a composition comprising a purified polypeptide comprising, consisting essentially of or consisting of the amino acid sequence of SEQ ID NO:1 or another peptide or agonist of the invention. In an embodiment, the composition is a pharmaceutical composition.

In a tenth aspect, the invention features a method for treating obesity, the method comprising administering a composition comprising a purified peptide comprising, consisting essentially of or consisting of the amino acid sequence of SEQ ID NO:1 or another peptide or agonist of the invention. The peptide can be administered in combination with one or more agents for treatment of obesity, including, without limitation, the anti-obesity agents described herein.

A peptide useful for treating obesity can be administered as a co-therapy with a peptide of the invention either as a distinct molecule or as part of a fusion protein with a peptide of the invention. Thus, for example, $PYY_{3-36}$ can be fused to the carboxy or amino terminus of a peptide of the invention. Such a fusion protein can include a chymostrypsin or trypsin cleavage site that can permit cleavage to separate the two peptides.

In an eleventh aspect, the invention features a method for treating congestive heart failure, the method comprising: administering to the patient a composition comprising a purified peptide comprising, consisting essentially of or consisting of the amino acid sequence of SEQ ID NO:1 or another peptide or agonist of the invention. The peptide can be administered in combination with one or more agents for treatment of congestive heart failure, for example, a natriuretic peptide such as atrial natriuretic peptide, brain natriuretic peptide or C-type natriuretic peptide), a diuretic, or an inhibitor of angiotensin converting enzyme.

In a twelfth aspect, the invention features a method for treating benign prostatic hyperplasia, the method comprising: administering to the patient a composition comprising a purified peptide comprising, consisting essentially of or consisting of the amino acid sequence of SEQ ID NO:1 or another peptide or agonist of the invention. The peptide can be administered in combination with one or more agents for treatment of BPH, for example, a 5-alpha reductase inhibitor (e.g., finasteride) or an alpha adrenergic inhibitor (e.g., doxazosine).

In a thirteenth aspect, the invention features a method for treating a patient suffering from a gastrointestinal disorder, the method comprising administering to the patient a composition comprising a complete or partial agonist of the GC-C receptor. In various embodiments, the patient is suffering from a gastrointestinal disorder; the patient is suffering from a disorder selected from the group consisting of: a gastrointestinal motility disorder, irritable bowel syndrome, a functional gastrointestinal disorder, gastroesophageal reflux disease, functional heartburn, dyspepsia, functional dyspepsia, nonulcer dyspepsia, gastroparesis, chronic intestinal pseudo-obstruction, and colonic pseudo-obstruction.

In a fourteenth aspect, the invention features a method for treating a patient suffering from constipation, the method comprising administering a composition comprising a complete or partial agonist of the GC-C receptor.

In a fifteenth aspect, the invention features a method for increasing gastrointestinal motility in a patient, the method comprising administering to the patient a composition comprising a complete or partial agonist of the GC-C receptor.

In a sixteenth aspect, the invention features a method for decreasing gastrointestinal pain or visceral pain in a patient, the method comprising administering to the patient a composition comprising a complete or partial agonist of the GC-C receptor.

In a seventeenth aspect, the invention features a method for treating congestive heart failure, the method comprising administering a complete or partial agonist of the GC-C receptor. GC-C agonists can act in the kidney and adrenal gland to control natriuresis, kaliuresis, and diuresis thereby reducing the build-up of fluid associated with congestive heart failure (Lorenz et al. *J Clin Invest* 112:1138, 2003; Carrithers et al. *Kidney Int* 65:40, 2004). The agonist can be administered in combination with one or more agents for treatment of congestive heart failure, for example, a natriuretic peptide such as atrial natriuretic peptide, brain natriuretic peptide or C-type natriuretic peptide), a diuretic, or an inhibitor of angiotensin converting enzyme.

In an eighteenth aspect, the invention features a method for treating BPH, the method comprising administering a complete or partial agonist of the GC-C receptor. GC-C agonists acting in the prostate can reduce cellular hypertrophy and complications associated with cellular hypertrophy. The agonist can be administered in combination with one or more agents for treatment of BPH, for example, a 5-alpha reductase inhibitor (e.g., finasteride) or an alpha adrenergic inhibitor (e.g., doxazosine).

In a nineteenth aspect, the invention features a method for treating obesity, the method comprising administering a complete or partial agonist of the GC-C receptor. The agonist can be administered in combination with one or more agents for treatment of obesity, for example, sibutramine.

The peptides and agonists of the GC-C receptor can be used to treat constipation or decreased intestinal motility, slow digestion or slow stomach emptying. The peptides can be used to relieve one or more symptoms of IBS (bloating, pain, constipation), GERD (acid reflux into the esophagus), duodenogastric reflux, functional dyspepsia, or gastroparesis (nausea, vomiting, bloating, delayed gastric emptying) and other disorders described herein.

Clinically accepted criteria that define constipation range from the frequency of bowel movements, the consistency of feces and the ease of bowel movement. One common definition of constipation is less than three bowel movements per week. Other definitions include abnormally hard stools or defecation that requires excessive straining (Schiller 2001, Aliment Pharmacol Ther 15:749-763). Constipation may be idiopathic (functional constipation or slow transit constipation) or secondary to other causes including neurologic, metabolic or endocrine disorders. These disorders include diabetes mellitus, hypothyroidism, hyperthyroidism, hypocalcaemia, Multiple Sclerosis, Parkinson's disease, spinal cord lesions, Neurofibromatosis, autonomic neuropathy, Chagas disease, Hirschsprung's disease and cystic fibrosis. Constipation may also be the result of surgery or due to the use of drugs such as analgesics (like opioids), antihypertensives, anticonvulsants, antidepressants, antispasmodics and antipsychotics.

In a twentieth aspect, the invention features isolated nucleic acid molecules comprising or consisting of a sequence encoding a peptide of the invention. The invention also features vectors, e.g., expression vectors that include such nucleic acid molecules and can be used to express a peptide of the invention in a cultured cell (e.g., a eukaryotic cell or a prokaryotic cell). The vector can further include one or more regulatory elements, e.g., a heterologous promoter or elements required for translation operably linked to the sequence encoding the peptide. In some cases the nucleic acid molecule will encode an amino acid sequence that includes the amino acid sequence of a peptide of the invention. For example, the nucleic acid molecule can encode a preprotein or a preproprotein that can be processed to produce a peptide of the invention.

A vector that includes a nucleotide sequence encoding a peptide of the invention or a peptide or polypeptide comprising a peptide of the invention may be either RNA or DNA, single- or double-stranded, prokaryotic, eukaryotic, or viral. Vectors can include transposons, viral vectors, episomes, (e.g., plasmids), chromosomes inserts, and artificial chromosomes (e.g. BACs or YACs). Suitable bacterial hosts for expression of the encode peptide or polypeptide include, but are not limited to, *E. coli*. Suitable eukaryotic hosts include yeast such as *S. cerevisiae*, other fungi, vertebrate cells, invertebrate cells (e.g., insect cells), plant cells, human cells, human tissue cells, and whole eukaryotic organisms. (e.g., a transgenic plant or a transgenic animal). Further, the vector nucleic acid can be used to generate a virus such as vaccinia or baculovirus.

As noted above the invention includes vectors and genetic constructs suitable for production of a peptide of the invention or a peptide or polypeptide comprising such a peptide. Generally, the genetic construct also includes, in addition to the encoding nucleic acid molecule, elements that allow expression, such as a promoter and regulatory sequences. The expression vectors may contain transcriptional control sequences that control transcriptional initiation, such as promoter, enhancer, operator, and repressor sequences. A variety of transcriptional control sequences are well known to those in the art and may be functional in, but are not limited to, a bacterium, yeast, plant, or animal cell. The expression vector can also include a translation regulatory sequence (e.g., an untranslated 5' sequence, an untranslated 3' sequence, a poly A addition site, or an internal ribosome entry site), a splicing sequence or splicing regulatory sequence, and a transcription termination sequence. The vector can be capable of autonomous replication or it can integrate into host DNA.

The invention also includes isolated host cells harboring one of the forgoing nucleic acid molecules and methods for producing a peptide by culturing such a cell and recovering the peptide or a precursor of the peptide. Recovery of the peptide or precursor may refer to collecting the growth solution and need not involve additional steps of purification. Proteins of the present invention, however, can be purified using standard purification techniques, such as, but not limited to, affinity chromatography, thermaprecipitation, immunoaffinity chromatography, ammonium sulfate precipitation, ion exchange chromatography, filtration, electrophoresis and hydrophobic interaction chromatography.

The peptides can be purified. Purified peptides are peptides separated from other proteins, lipids, and nucleic acids or from the compounds from which is it synthesized. The polypeptide can constitute at least 10, 20, 50 70, 80 or 95% by dry weight of the purified preparation.

In a twenty first aspect, the invention features a method of increasing the level of cyclic guanosine 3'-monophosphate (cGMP) in an organ, tissue (e.g., the intestinal mucosa), or cell (e.g., a cell bearing GC-A receptor) by administering a composition that includes a peptide of the invention.

In twenty second aspect, the invention features a method for treating a disorder ameliorated by increasing cGMP levels, the method comprising administering a pharmaceutical composition comprising, consisting essentially of or consisting of SEQ ID NO. 1 or a peptide or agonist of the invention and a pharmaceutically acceptable carrier.

The details of one or more embodiments of the invention are set forth in the accompanying description and claims.

In a twenty third aspect, the invention features a method for preparing a polypeptide of SEQ NO:1 or any of the other polypeptides described herein by: chemically synthesizing the polypeptide and at least partially purifying the synthesized polypeptide.

In a twenty fourth, the invention features a method for preparing a polypeptide of SEQ ID NO:1 or any of the other polypeptides described herein by: providing a host cells (e.g., a bacterial or mammalian or insect cell) harboring a nucleic acid molecule encoding the polypeptide, culturing the cell under conditions suitable for expression of the polypeptide, and at least partially purifying the polypeptide from the cell or the culture media in which the cell is cultured.

The publications and patents referenced herein are incorporated by reference.

DRAWINGS

FIG. 1 depicts deletion variants of human guanylin in which one, two, three or four amino acids are deleted. The deleted amino acids are between $Cys_a$ and $Cys_d$ as well as amino terminal to $Cys_a$.

FIG. 2 depicts insertion variants of human guanylin in which one, two, three or four amino acids are inserted. The inserted amino acids are between $Cys_a$ and $Cys_d$ as well as amino terminal to $Cys_a$ and carboxy terminal to $Cys_d$.

FIG. 3 depicts various polypeptides which include the amino acid sequence: $Xaa_1 Xaa_2 Xaa_3 Cys_4 Xaa_5 Xaa_6 Xaa_7 Xaa_8 Xaa_9 Xaa_{10} Xaa_{11} Cys_{12} Xaa_{13} Xaa_{14} Xaa_{15} Xaa_{16}$ (SEQ ID NO:1) wherein: $Xaa_1$ is any amino acid or is missing; $Xaa_2$ is any amino acid or is missing; $Xaa_3$ is any amino acid or is missing; $Xaa_5$ is Glu; $Xaa_6$ is Tyr, Trp, Phe or Leu; $Xaa_7$ is Cys; $Xaa_8$ is any of the 20 naturally-occurring amino acids other than Cys or is missing; $Xaa_9$ is any of the 20 naturally-occurring amino acids; $Xaa_{10}$ is Pro or Gly; $Xaa_{11}$ is any of the 20 naturally-occurring amino acids; $Xaa_{13}$ is Thr, Val or Gly; $Xaa_{14}$ is Gly or Ala; $Xaa_{15}$ is Cys; and $Xaa_{16}$ is any of the 20 naturally-occurring amino acids or is missing.

DETAILED DESCRIPTION

The peptides of the invention bind to the guanylate cyclase (GC-C) receptor, a key regulator of fluid and electrolyte balance in the intestine and kidney. When stimulated, this receptor, which is located on the apical membrane of the intestinal epithelial surface, causes an increase in intestinal epithelial cyclic GMP (cGMP). This increase in cGMP is believed to cause a decrease in water and sodium absorption and an increase in chloride and potassium ion secretion, leading to changes in intestinal fluid and electrolyte transport and increased intestinal motility. The intestinal GC-C receptor possesses an extracellular ligand binding region, a transmembrane region, an intracellular protein kinase-like region and a cyclase catalytic domain. Proposed functions for the GC-C receptor are the fluid and electrolyte homeostasis, the regulation of epithelial cell proliferation and the induction of apoptosis (Shailhubhai 2002 *Curr Opin Drug Dis Devel* 5:261-268).

In addition to being expressed in gastrointestinal epithelial cells, GC-C is expressed in extra-intestinal tissues including kidney, lung, pancreas, pituitary, adrenal, developing liver, heart and male and female reproductive tissues (reviewed in Vaandrager 2002 *Mol Cell Biochem* 230:73-83). This suggests that the GC-C receptor agonists can be used in the treatment of disorders outside the GI tract, for example, congestive heart failure and benign prostatic hyperplasia.

Ghrelin, a peptide hormone secreted by the stomach, is a key regulator of appetite in humans. Ghrelin expression levels are regulated by fasting and by gastric emptying. (Kim et al., 2003, Neuroreprt 14:1317-20; Gualillo et al., 2003, FEBS Letts 552: 105-9). Thus, by increasing gastrointestinal motility, GC-C receptor agonists may also be used to regulate obesity.

In humans, the GC-C receptor is activated by guanylin (Gn) (U.S. Pat. No. 5,969,097), uroguanylin (Ugn) (U.S. Pat. No. 5,140,102) and lymphoguanylin (Forte et al. 1999 *Endocrinology* 140:1800-1806).

Many gastrointestinal disorders, including IBS, are associated with abdominal or visceral pain. Certain of the peptides of the invention include the analgesic or anti-nociceptive tags such as the carboxy-terminal sequence AspPhe immediately following a Trp, Tyr or Phe (i.e., a chymotrypsin cleavage site) or following Lys or Arg (a trypsin cleavage site). Chymotrypsin in the intestinal tract will cleave such peptides immediately carboxy terminal to the Trp, Phe or Tyr residue, releasing the dipeptide, AspPhe. This dipeptide has been shown to have analgesic activity is animal models (Abdikkahi et al. 2001 *Fundam Clin Pharmacol* 15:117-23; Nikfar et al 1997, 29:583-6; Edmundson et al 1998 *Clin Pharmacol Ther* 63:580-93). In this manner such peptides can treat both pain and inflammation. Other analgesic peptides can be present at the carboxy terminus of the peptide (following a cleavage site) including: endomorphin-1, endomorphin-2, nocistatin, dalargin, lupron, ziconotide, and substance P. As described in greater detail below, various analgesic peptides and compounds can be covalently linked to or used in combination therapy with the therapeutic peptides described herein.

In the human body an inactive form of chymotrypsin, chymotrypsinogen is produced in the pancreas. When this inactive enzyme reaches the small intestine it is converted to active chymotrypsin by the excision of two di-peptides. Active chymotrypsin will cleave peptides at the peptide bond on the carboxy-terminal side of Trp, Tyr or Phe. The presence of active chymotrypsin in the intestinal tract will lead to cleavage of certain of the peptides of the invention having an appropriately positioned chymotrypsin cleavage site. Certain of the peptides of the invention include a Trp, Tyr or Phe immediately followed by a carboxy-terminal analgesic peptide. It is expected that chymotrypsin cleavage will release the analgesic peptide from peptide of the invention having an appropriately positioned chymotrypsin cleavage site as the peptide passes through the intestinal tract.

Trypsinogen, like chymotrypsin, is a serine protease that is produced in the pancreas and is present in the digestive tract. The active form, trypsin, will cleave peptides having a Lys or Arg. The presence of active trypsin in the intestinal tract will lead to cleavage of certain of the peptides of the invention having an appropriately positioned trypsin cleavage site. It is expected that chymotrypsin cleavage will release the analgesic peptide from peptide of the invention having an appropriately positioned trypsin cleavage site as the peptide passes through the intestinal tract.

In some cases, the peptides of the invention are produced as a prepro protein. The prepro protein can include any suitable prepro sequence, including, for example, mnafllsalc llgawaalag gvtvqdgnfs fslesvkklk dlqepqeprv gklrnfapip gepvvpilcs npnfpeelkp lckepnaqei lqrleeiaed (SEQ ID NO:8624) and mgcraasgll pgvavvllll lqstqsvyiq yqgfrvqles mkklsdleaq wapsprlqaq sllpavchhp alpqdlqpvc asqeassifk tlrtia (SEQ ID NO:8625) or a bacterial leader sequence such as: mkksilfiflsvlsfspfaqdakpvesskekitleskkcniakksnksgpesmn. Where the peptide is produced by a bacterial cell, e.g., *E. coli*, the forgoing leader sequence will be cleaved and the mature peptide will be efficiently secreted from the bacterial cell. U.S. Pat. No. 5,395,490 describes vectors, expression systems and methods for the efficient production of certain mature peptides having disulfide bonds in bacterial cells and methods for achieving efficient secretion of such mature peptides. The vectors, expression systems and methods described in U.S. Pat. No. 5,395,490 can be used to produce the polypeptides of the present invention.

Variant Peptides

The invention includes variant peptides that can include one, two, three, four, or five or more (e.g., 6, 7, 8, 9, 10, 11, 12, 13, 14, or 15) amino acid substitutions compared to any of the peptides described above. The substitution(s) can be conservative or non-conservative. The naturally-occurring amino acids can be substituted by D-isomers of any amino acid, non-natural amino acids, natural and non-natural amino acid analogs, and other groups. A conservative amino acid substitution results in the alteration of an amino acid for a similar acting amino acid, or amino acid of like charge, polarity, or hydrophobicity. At some positions, even conservative amino acid substitutions can reduce the activity of the peptide. A conservative substitution can substitute a naturally-occurring amino acid for a non-naturally-occurring amino acid. Among the naturally occurring amino acid substitutions generally considered conservative are:

| For Amino Acid | Code | Replace with any of |
|---|---|---|
| Alanine | Ala | Gly, Cys, Ser |
| Arginine | Arg | Lys, His |
| Asparagine | Asn | Asp, Glu, Gln, |
| Aspartic Acid | Asp | Asn, Glu, Gln |
| Cysteine | Cys | Met, Thr, Ser |
| Glutamine | Gln | Asn, Glu, Asp |
| Glutamic Acid | Glu | Asp, Asn, Gln |
| Glycine | Gly | Ala |
| Histidine | His | Lys, Arg |
| Isoleucine | Ile | Val, Leu, Met |
| Leucine | Leu | Val, Ile, Met |
| Lysine | Lys | Arg, His |
| Methionine | Met | Ile, Leu, Val |
| Phenylalanine | Phe | Tyr, His, Trp |
| Proline | Pro | |
| Serine | Ser | Thr, Cys, Ala |
| Threonine | Thr | Ser, Met, Val |
| Tryptophan | Trp | Phe, Tyr |
| Tyrosine | Tyr | Phe, His |
| Valine | Val | Leu, Ile, Met |

In some circumstances it can be desirable to treat patients with a variant peptide that binds to and activates intestinal GC-C receptor, but is less active or more active than the non-variant form of the peptide. Reduced activity can arise from reduced affinity for the receptor or a reduced ability to activate the receptor once bound or reduced stability of the peptide. Increased activity can arise from increased affinity for the receptor or an increased ability to activate the receptor once bound or increased stability of the peptide.

In some peptides one or both members of one or both pairs of Cys residues which normally form a disulfide bond can be replaced by homocysteine, 3-mercaptoproline (Kolodziej et al. 1996 *Int J Pept Protein Res* 48:274); β, β dimethylcysteine (Hunt et al. 1993 *Int J Pept Protein Res* 42:249) or diaminopropionic acid (Smith et al. 1978 *J Med Chem* 21:117) to form alternative internal cross-links at the positions of the normal disulfide bonds.

Production of Peptides

Useful peptides can be produced either in bacteria including, without limitation, *E. coli*, or in other existing systems for peptide or protein production (e.g., *Bacillus subtilis*, baculovirus expression systems using *Drosophila* Sf9 cells, yeast or filamentous fungal expression systems, mammalian cell expression systems), or they can be chemically synthesized.

If the peptide or variant peptide is to be produced in bacteria, e.g., *E. coli*, the nucleic acid molecule encoding the peptide may also encode a leader sequence that permits the secretion of the mature peptide from the cell. Thus, the sequence encoding the peptide can include the pre sequence and the pro sequence of, for example, a naturally-occurring bacterial ST peptide. The secreted, mature peptide can be purified from the culture medium.

The sequence encoding a peptide of the invention is can be inserted into a vector capable of delivering and maintaining the nucleic acid molecule in a bacterial cell. The DNA molecule may be inserted into an autonomously replicating vector (suitable vectors include, for example, pGEM3Z and pcDNA3, and derivatives thereof). The vector nucleic acid may be a bacterial or bacteriophage DNA such as bacteriophage lambda or M13 and derivatives thereof. Construction of a vector containing a nucleic acid described herein can be followed by transformation of a host cell such as a bacterium. Suitable bacterial hosts include but are not limited to, *E. coli*, B subtilis, *Pseudomonas, Salmonella*. The genetic construct also includes, in addition to the encoding nucleic acid molecule, elements that allow expression, such as a promoter and regulatory sequences. The expression vectors may contain transcriptional control sequences that control transcriptional initiation, such as promoter, enhancer, operator, and repressor sequences. A variety of transcriptional control sequences are well known to those in the art. The expression vector can also include a translation regulatory sequence (e.g., an untranslated 5' sequence, an untranslated 3' sequence, or an internal ribosome entry site). The vector can be capable of autonomous replication or it can integrate into host DNA to ensure stability during peptide production.

The protein coding sequence that includes a peptide of the invention can also be fused to a nucleic acid encoding a polypeptide affinity tag, e.g., glutathione S-transferase (GST), maltose E binding protein, protein A, FLAG tag, hexa-histidine, myc tag or the influenza HA tag, in order to facilitate purification. The affinity tag or reporter fusion joins the reading frame of the peptide of interest to the reading frame of the gene encoding the affinity tag such that a translational fusion is generated. Expression of the fusion gene results in translation of a single polypeptide that includes both the peptide of interest and the affinity tag. In some instances where affinity tags are utilized, DNA sequence encoding a protease recognition site will be fused between the reading frames for the affinity tag and the peptide of interest.

Genetic constructs and methods suitable for production of immature and mature forms of the peptides and variants of the invention in protein expression systems other than bacteria, and well known to those skilled in the art, can also be used to produce peptides in a biological system.

Mature peptides and variants thereof can be synthesized by the solid-phase method using an automated peptide synthesizer. For example, the peptide can be synthesized on Cyc(4-$CH_2$ Bxl)-$OCH_2$-4-(oxymethyl)-phenylacetamidomethyl resin using a double coupling program.

Protecting groups must be used appropriately to create the correct disulfide bond pattern. For example, the following protecting groups can be used: t-butyloxycarbonyl (alpha-amino groups); acetamidomethyl (thiol groups of Cys residues B and E); 4-methylbenyl (thiol groups of Cys residues C and F); benzyl (y-carboxyl of glutamic acid and the hydroxyl group of threonine, if present); and bromobenzyl (phenolic group of tyrosine, if present). Coupling is effected with symmetrical anhydride of t-butoxylcarbonylamino acids or hydroxybenzotriazole ester (for asparagine or glutamine residues), and the peptide is deprotected and cleaved from the solid support in hydrogen fluoride, dimethyl sulfide, anisole, and p-thiocresol using 8/1/1/0.5 ratio (v/v/v/w) at 0° C. for 60 min. After removal of hydrogen fluoride and dimethyl sulfide by reduced pressure and anisole and p-thiocresol by extraction with ethyl ether and ethyl acetate sequentially, crude peptides are extracted with a mixture of 0.5M sodium phosphate buffer, pH 8.0 and N,N-dimethylformamide using 1/1 ratio, v/v. Disulfide bonds between Cys residues can be formed using dimethyl sulfoxide (Tam et al. (1991) J. Am. Chem. Soc. 113:6657-62). The resulting peptide is the purified by reverse-phase chromatography. In some cases it may be necessary to first dissolve the peptide in 50% acetic acid in water before disulfide bond formation. Saturated iodine solution in glacial acetic acid is added (1 ml iodine solution per 100 ml solution). After incubation at room temperature for 2 days in closed glass container, the solution is diluted five-fold with deionized water and extracted with ethyl ether four times for removal of unreacted iodine. After removal of the residual amount of ethyl ether by rotary evaporation the solution of crude product is lyophilized and purified by successive reverse-phase chromatography.

Intestinal GC-C Receptor Binding and Activity Assays

The ability of peptides, variant peptides and other compounds to bind to and activate the intestinal GC-C receptor can be tested using the T84 human colon carcinoma cell line (American Type Culture Collection (Bethesda, Md.).

Briefly, cells are grown to confluency in 24-well culture plates with a 1:1 mixture of Ham's F12 medium and Dulbecco's modified Eagle's medium (DMEM), supplemented with 5% fetal calf serum and are used at between passages 54 and 60.

Monolayers of T84 cells in 24-well plates are washed twice with 1 ml/well DMEM, then incubated at 37° C. for 10 min with 0.45 ml DMEM containing 1 mM isobutylmethylxanthine (IBMX), a cyclic nucleotide phosphodiesterase inhibitor. Test peptides (50 μl) are then added and incubated for 30 minutes at 37° C. The media is aspirated and the reaction is terminated by the addition of ice cold 0.5 ml of 0.1 N HCl. The samples are held on ice for 20 minutes and then evaporated to dryness using a heat gun or vacuum centrifugation. The dried samples are resuspended in 0.5 ml of phosphate buffer provided in the Cayman Chemical Cyclic GMP EIA kit (Cayman Chemical, Ann Arbor, Mich.). Cyclic GMP is measured by EIA according to procedures outlined in the Cayman Chemical Cyclic GMP EIA kit.

For the binding assay, T84 cell monolayers in 24-well plates are washed twice with 1 ml of binding buffer (DMEM containing 0.05% bovine serum albumin and 25 mM HEPES, pH 7.2), then incubated for 30 min at 37° C. in the presence of mature radioactively labeled *E. coli* ST peptide and the test material at various concentrations. The cells are then washed 4 times with 1 ml of DMEM and solubilized with 0.5 ml/well 1N NaOH. The level of radioactivity in the solubilized material is then determined using standard methods.

Murine Gastrointestinal Transit (GIT) Assay

In order to determine whether a test compound or a peptide, increases the rate of gastrointestinal transit, the test compound can be tested in the murine gastrointestinal transit (GIT) assay (Moon et al. *Infection and Immunity* 25:127, 1979). In this assay, charcoal, which can be readily visualized in the gastrointestinal tract is administered to mice after the administration of a test compound. The distance traveled by the charcoal is measured and expressed as a percentage of the total length of the colon.

Mice are fasted with free access to water for 12 to 16 hours before the treatment with peptide or control buffer. The peptides are orally administered at 1 µg/kg-1 mg/kg of peptide in buffer (20 mM Tris pH 7.5) seven minutes before being given an oral dose of 5% Activated Carbon (Aldrich 242276-250G). Control mice are administered buffer only before being given a dose of Activated Carbon. After 15 minutes, the mice are sacrificed and their intestines from the stomach to the cecum are dissected. The total length of the intestine as well as the distance traveled from the stomach to the charcoal front is measured for each animal and the results are expressed as the percent of the total length of the intestine traveled by the charcoal front. Results are reported as the average of 10 mice±standard deviation. A comparison of the distance traveled by the charcoal between the mice treated with peptide versus the mice treated with vehicle alone is performed using a Student's ±test and a statistically significant difference is considered for $P<0.05$. Positive controls for this assay may include commercially available wild-type ST peptide (Sigma-Aldrich, St Louis, Mo.) and Zelnorm®, a drug approved for IBS that is an agonist for the serotonin receptor 5HT4.

Suckling Mouse Model of Intestinal Secretion (SuMi Assay)

The peptides of the invention can be tested for their ability to increase intestinal secretion using a suckling mouse model of intestinal secretion. In this model a test compound is administered to suckling mice that are between seven and nine days old. After the mice are sacrificed, the gastrointestinal tract from the stomach to the cecum is dissected ("guts"). The remains ("carcass") as well as the guts are weighed and the ratio of guts to carcass weight is calculated. If the ratio is above 0.09, one can conclude that the test compound increases intestinal secretion. Controls for this assay may include wild-type ST peptide and Zelnorm®

Phenylbenzoquinone-induced Writhing Model

The PBQ-induced writhing model can be used to assess pain control activity of the peptides and GC-C receptor agonists of the invention. This model is described by Siegmund et al. (1957 Proc. Soc. Exp. Bio. Med. 95:729-731). Briefly, one hour after oral dosing with a test compound, e.g., a peptide, morphine or vehicle, 0.02% phenylbenzoquinone (PBQ) solution (12.5 mL/kg) is injected by intraperitoneal route into the mouse. The number of stretches and writhings are recorded from the $5^{th}$ to the $10^{th}$ minute after PBQ injection, and can also be counted between the $35^{th}$ and $40^{th}$ minute and between the $60^{th}$ and $65^{th}$ minute to provide a kinetic assessment. The results are expressed as the number of stretches and writhings (mean ±SEM) and the percentage of variation of the nociceptive threshold calculated from the mean value of the vehicle-treated group. The statistical significance of any differences between the treated groups and the control group is determined by a Dunnett's test using the residual variance after a one-way analysis of variance ($P<0.05$) using SigmaStat Software.

Colonic Hyperalgesia Animal Models

Hypersensitivity to colorectal distension is a common feature in patients with IBS and may be responsible for the major symptom of pain. Both inflammatory and non-inflammatory animal models of visceral hyperalgesia to distension have been developed to investigate the effect of compounds on visceral pain in IBS.

I. Trinitrobenzenesulphonic Acid (TNBS)-Induced Rectal Allodynia Model

Male Wistar rats (220-250 g) are premedicated with 0.5 mg/kg of acepromazine injected intraperitoneally (IP) and anesthetized by intramuscular administration of 100 mg/kg of ketamine. Pairs of nichrome wire electrodes (60 cm in length and 80 µm in diameter) are implanted in the striated muscle of the abdomen, 2 cm laterally from the white line. The free ends of electrodes are exteriorized on the back of the neck and protected by a plastic tube attached to the skin. *Electromyographic* (EMG) recordings are started 5 days after surgery. Electrical activity of abdominal striated muscle is recorded with an electroencephalograph machine (Mini VIII, Alvar, Paris, France) using a short time constant (0.03 sec.) to remove low-frequency signals (<3 Hz).

Ten days post surgical implantation, trinitrobenzenesulphonic acid (TNBS) is administered to induce rectal inflammation. TNBS (80 mg $kg^{-1}$ in 0.3 ml 50% ethanol) is administered intrarectally through a silicone rubber catheter introduced at 3 cm from the anus under light diethyl-ether anesthesia, as described (Morteau et al. 1994 Dig Dis Sci 39:1239). Following TNBS administration, rats are placed in plastic tunnels where they are severely limited in mobility for several days before colorectal distension (CRD). Experimental compound is administered one hour before CRD which is performed by insertion into the rectum, at 1 cm of the anus, a 4 cm long balloon made from a latex condom (Gue et al, 1997 *Neurogastroenterol. Motil.* 9:271). The balloon is fixed on a rigid catheter taken from an embolectomy probe (Fogarty). The catheter attached balloon is fixed at the base of the tail. The balloon, connected to a barostat is inflated progressively by step of 15 mmHg, from 0 to 60 mmHg, each step of inflation lasting 5 min. Evaluation of rectal sensitivity, as measured by EMG, is performed before (1-2 days) and 3 days following rectal instillation of TNBS.

The number of spike bursts that corresponds to abdominal contractions is determined per 5 min periods. Statistical analysis of the number of abdominal contractions and evaluation of the dose-effects relationships is performed by a one way analysis of variance (ANOVA) followed by a post-hoc (Student or Dunnett tests) and regression analysis for ED50 if appropriate.

II. Stress-induced Hyperalgesia Model

Male Wistar Rats (200-250 g) are surgically implanted with nichrome wire electrodes as in the TNBS model. Ten days post surgical implantation, partial restraint stress (PRS), is performed as described by Williams et al. for two hours (Williams et al. 1988 Gastroenterology 64:611). Briefly, under light anaesthesia with ethyl-ether, the foreshoulders, upper forelimbs and thoracic trunk are wrapped in a confining harness of paper tape to restrict, but not prevent body movements. Control sham-stress animals are anaesthetized but not wrapped. Thirty minutes before the end of the PRS session, the animals are administered test-compound or vehicle. Thirty minutes to one hour after PRS completion, the CRD distension procedure is performed as described above for the TNBS model with barostat at pressures of 15, 30, 45 and 60 mm Hg. Statistical analysis on the number of bursts is determined and analyzed as in the TNBS model above.

Administration of Peptides and GC-C Receptor Agonists

For treatment of gastrointestinal disorders, the peptides and agonists of the invention are preferably administered orally, e.g., as a tablet or cachet containing a predetermined amount of the active ingredient, pellet, gel, paste, syrup, bolus, electuary, slurry, sachet; capsule; powder; lyophilized powder; granules; as a solution or a suspension in an aqueous liquid or a non-aqueous liquid; as an oil-in-water liquid emulsion or a water-in-oil liquid emulsion, via a liposomal formulation (see, e.g., EP 736299) or in some other form. Orally administered compositions can include binders, lubricants, inert diluents, lubricating, surface active or dispersing agents, flavoring agents, and humectants. Orally administered formulations such as tablets may optionally be coated or scored and may be formulated so as to provide sustained, delayed or controlled release of the active ingredient therein. The peptides and agonists can be co-administered with other agents used to treat gastrointestinal disorders including but not limited to the agents described herein. The peptides and agonists can also be administered by rectal suppository. For the treatment of disorders outside the gastrointestinal tract such as congestive heart failure and benign prostatic hypertrophy, peptides and agonists are preferably administered parenterally or orally.

The peptides described herein can be administered alone or in combination with other agents. For example, the peptides can be administered together with an analgesic peptide or compound. The analgesic peptide or compound can be covalently attached to a peptide described herein or it can be a separate agent that is administered together with or sequentially with a peptide described herein in a combination therapy.

Combination therapy can be achieved by administering two or more agents, e.g., a peptide described herein and an analgesic peptide or compound, each of which is formulated and administered separately, or by administering two or more agents in a single formulation. Other combinations are also encompassed by combination therapy. For example, two agents can be formulated together and administered in conjunction with a separate formulation containing a third agent. While the two or more agents in the combination therapy can be administered simultaneously, they need not be. For example, administration of a first agent (or combination of agents) can precede administration of a second agent (or combination of agents) by minutes, hours, days, or weeks. Thus, the two or more agents can be administered within minutes of each other or within 1, 2, 3, 6, 9, 12, 15, 18, or 24 hours of each other or within 1, 2, 3, 4, 5, 6, 7, 8, 9, 10, 12, 14 days of each other or within 2, 3, 4, 5, 6, 7, 8, 9, or 10 weeks of each other. In some cases even longer intervals are possible. While in many cases it is desirable that the two or more agents used in a combination therapy be present in within the patient's body at the same time, this need not be so.

Combination therapy can also include two or more administrations of one or more of the agents used in the combination. For example, if agent X and agent Y are used in a combination, one could administer them sequentially in any combination one or more times, e.g., in the order X—Y—X, X—X—Y, Y—X—Y, Y—Y—X, X—X—Y—Y, etc.

The agents, alone or in combination, can be combined with any pharmaceutically acceptable carrier or medium. Thus, they can be combined with materials that do not produce an adverse, allergic or otherwise unwanted reaction when administered to a patient. The carriers or mediums used can include solvents, dispersants, coatings, absorption promoting agents, controlled release agents, and one or more inert excipients (which include starches, polyols, granulating agents, microcrystalline cellulose, diluents, lubricants, binders, disintegrating agents, and the like), etc. If desired, tablet dosages of the disclosed compositions may be coated by standard aqueous or nonaqueous techniques.

Compositions of the present invention may also optionally include other therapeutic ingredients, anti-caking agents, preservatives, sweetening agents, colorants, flavors, desiccants, plasticizers, dyes, and the like. Any such optional ingredient must be compatible with the compound of the invention to insure the stability of the formulation. The composition may contain other additives as needed, including for example lactose, glucose, fructose, galactose, trehalose, sucrose, maltose, raffinose, maltitol, melezitose, stachyose, lactitol, palatinite, starch, xylitol, mannitol, myoinositol, and the like, and hydrates thereof, and amino acids, for example alanine, glycine and betaine, and peptides and proteins, for example albumen.

Examples of excipients for use as the pharmaceutically acceptable carriers and the pharmaceutically acceptable inert carriers and the aforementioned additional ingredients include, but are not limited to binders, fillers, disintegrants, lubricants, anti-microbial agents, and coating agents such as:

BINDERS: corn starch, potato starch, other starches, gelatin, natural and synthetic gums such as acacia, sodium alginate, alginic acid, other alginates, powdered tragacanth, guar gum, cellulose and its derivatives (e.g., ethyl cellulose, cellulose acetate, carboxymethyl cellulose calcium, sodium carboxymethyl cellulose), polyvinyl pyrrolidone, methyl cellulose, pre-gelatinized starch (e.g., STARCH 1500® and STARCH 1500 LM®, sold by Colorcon, Ltd.), hydroxypropyl methyl cellulose, microcrystalline cellulose (e.g. AVICEL™, such as, AVICEL-PH-101™, -103™ and -105™, sold by FMC Corporation, Marcus Hook, Pa., USA), or mixtures thereof, FILLERS: talc, calcium carbonate (e.g., granules or powder), dibasic calcium phosphate, tribasic calcium phosphate, calcium sulfate (e.g., granules or powder), microcrystalline cellulose, powdered cellulose, dextrates, kaolin, mannitol, silicic acid, sorbitol, starch, pre-gelatinized starch, or mixtures thereof, DISINTEGRANTS: agar-agar, alginic acid, calcium carbonate, microcrystalline cellulose, croscarmellose sodium, crospovidone, polacrilin potassium, sodium starch glycolate, potato or tapioca starch, other starches, pre-gelatinized starch, clays, other algins, other celluloses, gums, or mixtures thereof, LUBRICANTS: calcium stearate, magnesium stearate, mineral oil, light mineral oil, glycerin, sorbitol, mannitol, polyethylene glycol, other glycols, stearic acid, sodium lauryl sulfate, talc, hydrogenated vegetable oil (e.g., peanut oil, cottonseed oil, sunflower oil, sesame oil, olive oil, corn oil and soybean oil), zinc stearate, ethyl oleate, ethyl laurate, agar, syloid silica gel (AEROSIL 200, W.R. Grace Co., Baltimore, Md. USA), a coagulated aerosol of synthetic silica (Deaussa Co., Plano, Tex. USA), a pyrogenic silicon dioxide (CAB-O-SIL, Cabot Co., Boston, Mass. USA), or mixtures thereof, ANTI-CAKING AGENTS: calcium silicate, magnesium silicate, silicon dioxide, colloidal silicon dioxide, talc, or mixtures thereof, ANTIMICROBIAL AGENTS: benzalkonium chloride, benzethonium chloride, benzoic acid, benzyl alcohol, butyl paraben, cetylpyridinium chloride, cresol, chlorobutanol, dehydroacetic acid, ethylparaben, methylparaben, phenol, phenylethyl alcohol, phenoxyethanol, phenylmercuric acetate, phenylmercuric nitrate, potassium sorbate, propylparaben, sodium benzoate, sodium dehydroacetate, sodium propionate, sorbic acid, thimersol, thymo, or mixtures thereof, and COATING AGENTS: sodium carboxymethyl cellulose, cellulose acetate phthalate, ethylcellulose, gelatin, pharmaceutical glaze, hydroxypropyl cellulose, hydroxypropyl methylcellulose, hydroxypropyl methyl cellulose phthalate, methylcellulose, polyethylene glycol, polyvinyl acetate phthalate, shellac, sucrose, titanium dioxide, carnauba wax, microcrystalline wax, or mixtures thereof.

The agents either in their free form or as a salt can be combined with a polymer such as polylactic-glycoloic acid (PLGA), poly-(I)-lactic-glycolic-tartaric acid (P(I)LGT) (WO 01/12233), polyglycolic acid (U.S. Pat. No. 3,773,919), polylactic acid (U.S. Pat. No. 4,767,628), poly($\epsilon$-caprolactone) and poly(alkylene oxide) (U.S. 20030068384) to create a sustained release formulation. Such formulations can be used to implants that release a peptide or another agent over a period of a few days, a few weeks or several months depending on the polymer, the particle size of the polymer, and the size of the implant (see, e.g., U.S. Pat. No. 6,620,422). Other sustained release formulations and polymers for use in are described in EP 0 467 389 A2, WO 93/24150, U.S. Pat. No. 5,612,052, WO 97/40085, WO 03/075887, WO 01/01964A2, U.S. Pat. No. 5,922,356, WO 94/155587, WO 02/074247A2, WO 98/25642, U.S. Pat. No. 5,968,895, U.S. Pat. No. 6,180, 608, U.S. 20030171296, U.S. 20020176841, U.S. Pat. No. 5,672,659, U.S. Pat. No. 5,893,985, U.S. Pat. No. 5,134,122, U.S. Pat. No. 5,192,741, U.S. Pat. No. 5,192,741, U.S. Pat. No. 4,668,506, U.S. Pat. No. 4,713,244, U.S. Pat. No. 5,445, 832 U.S. Pat. No. 4,931,279, U.S. Pat. No. 5,980,945, WO 02/058672, WO 9726015, WO 97/04744, and. US20020019446. In such sustained release formulations microparticles of peptide are combined with microparticles of polymer. One or more sustained release implants can be placed in the large intestine, the small intestine or both. U.S. Pat. No. 6,011,011 and WO 94/06452 describe a sustained release formulation providing either polyethylene glycols (i.e. PEG 300 and PEG 400) or triacetin. WO 03/053401 describes a formulation which may both enhance bioavailability and provide controlled releaseof the agent within the GI tract. Additional controlled release formulations are described in WO 02/38129, EP 326 151, U.S. Pat. No. 5,236, 704, WO 02/30398, WO 98/13029; U.S. 20030064105, U.S. 20030138488A1, U.S. 20030216307A1, U.S. Pat. No. 6,667, 060, WO 01/49249, WO 01/49311, WO 01/49249, WO 01/49311, and U.S. Pat. No. 5,877,224.

The agents can be administered, e.g., by intravenous injection, intramuscular injection, subcutaneous injection, intraperitoneal injection, topical, sublingual, intraarticular (in the joints), intradermal, buccal, ophthalmic (including intraocular), intranasaly (including using a cannula), intraspinally, intrathecally, or by other routes. The agents can be administered orally, e.g., as a tablet or cachet containing a predetermined amount of the active ingredient, gel, pellet, paste, syrup, bolus, electuary, slurry, capsule, powder, lyophilized powder, granules, sachet, as a solution or a suspension in an aqueous liquid or a non-aqueous liquid, as an oil-in-water liquid emulsion or a water-in-oil liquid emulsion, via a micellar formulation (see, e.g. WO 97/11682) via a liposomal formulation (see, e.g., EP 736299, WO 99/59550 and WO 97/13500), via formulations described in WO 03/094886 or in some other form. Orally administered compositions can include binders, lubricants, inert diluents, lubricating, surface active or dispersing agents, flavoring agents, and humectants. Orally administered formulations such as tablets may optionally be coated or scored and may be formulated so as to provide sustained, delayed or controlled release of the active ingredient therein. The agents can also be administered transdermally (i.e. via reservoir-type or matrix-type patches, microneedles, thermal poration, hypodermic needles, iontophoresis, electroporation, ultrasound or other forms of sonophoresis, jet injection, or a combination of any of the preceding methods (Prausnitz et al. 2004, Nature Reviews Drug Discovery 3:115-124)). The agents can be administered using high-velocity transdermal particle injection techniques using the hydrogel particle formulation described in U.S. 20020061336.

Additional particle formulations are described in WO 00/45792, WO 00/53160, and WO 02/19989. An example of a transdermal formulation containing plaster and the absorption promoter dimethylisosorbide can be found in WO 89/04179. WO 96/11705 provides formulations suitable for transdermal adminisitration. The agents can be administered in the form a suppository or by other vaginal or rectal means. The agents can be administered in a transmembrane formulation as described in WO 90/07923. The agents can be administed non-invasively via the dehydrated particicles described in U.S. Pat. No. 6,485,706. The agent can be administered in an enteric-coated drug formulation as described in WO 02/49621. The agents can be administered intranassaly using the formulation described in U.S. Pat. No. 5,179,079.

Formulations suitable for parenteral injection are described in WO 00/62759. The agents can be administered using the casein formulation described in U.S. 20030206939 and WO 00/06108. The agents can be administered using the particulate formulations described in U.S. 20020034536.

The agents, alone or in combination with other suitable components, can be administered by pulmonary route utilizing several techniques including but not limited to intratracheal instillation (delivery of solution into the lungs by syringe), intratracheal delivery of liposomes, insufflation (administration of powder formulation by syringe or any other similar device into the lungs) and aerosol inhalation. Aerosols (e.g., jet or ultrasonic nebulizers, metered-dose inhalers (MDIs), and dry-powder inhalers (DPIs)) can also be used in intranasal applications. Aerosol formulations are stable dispersions or suspensions of solid material and liquid droplets in a gaseous medium and can be placed into pressurized acceptable propellants, such as hydrofluroalkanes (HFAs, i.e. HFA-134a and HFA-227, or a mixture thereof), dichlorodifluoromethane (or other chlorofluocarbon propellants such as a mixture of Propellants 11, 12, and/or 114), propane, nitrogen, and the like. Pulmonary formulations may include permeation enhancers such as fatty acids, and saccharides, chelating agents, enzyme inhibitors (e.g., protease inhibitors), adjuvants (e.g., glycocholate, surfactin, span 85, and nafamostat), preservatives (e.g., benzalkonium chloride or chlorobutanol), and ethanol (normally up to 5% but possibly up to 20%, by weight). Ethanol is commonly included in aerosol compositions as it can improve the function of the metering valve and in some cases also improve the stability of the dispersion. Pulmonary formulations may also include surfactants which include but are not limited to bile salts and those described in U.S. Pat. No. 6,524,557 and references therein. The surfactants described in U.S. Pat. No. 6,524,557, e.g., a C8-C16 fatty acid salt, a bile salt, a phospholipid, or alkyl saccharide are advantageous in that some of them also reportedly enhance absorption of the peptide in the formulation. Also suitable in the invention are dry powder formulations comprising a therapeutically effective amount of active compound blended with an appropriate carrier and adapted for use in connection with a dry-powder inhaler. Absorption enhancers which can be added to dry powder formulations of the present invention include those described in U.S. Pat. No. 6,632,456. WO 02/080884 describes new methods for the surface modification of powders. Aerosol formulations may include U.S. Pat. No. 5,230,884, U.S. Pat. No. 5,292,499, WO 017/8694, WO 01/78696, U.S. 2003019437, U.S. 20030165436, and WO 96/40089 (which includes vegetable oil). Sustained release formulations suitable for inhalation are described in U.S. 20010036481A1, 20030232019A1, and U.S. 20040018243A1 as well as in WO 01/13891, WO 02/067902, WO 03/072080, and WO 03/079885. Pulmonary formulations containing microparticles are described in WO 03/015750, U.S. 20030008013, and WO 00/00176. Pulmonary formulations containing stable glassy state powder are described in U.S. 20020141945 and U.S. Pat. No. 6,309,671. Other aerosol formulations are desribed in EP 1338272A1 WO 90/09781, U.S. Pat. No. 5,348,730, U.S. Pat. No. 6,436, 367, WO 91/04011, and U.S. Pat. No. 6,294,153 and U.S. Pat. No. 6,290,987 describes a liposomal based formulation that can be administered via aerosol or other means. Powder formulations for inhalation are described in U.S. 20030053960 and WO 01/60341. The agents can be administered intranasally as described in U.S. 20010038824.

Solutions of medicament in buffered saline and similar vehicles are commonly employed to generate an aerosol in a nebulizer. Simple nebulizers operate on Bernoulli's principle and employ a stream of air or oxygen to generate the spray particles. More complex nebulizers employ ultrasound to create the spray particles. Both types are well known in the art and are described in standard textbooks of pharmacy such as Sprowls' American Pharmacy and Remington's The Science and Practice of Pharmacy. Other devices for generating aerosols employ compressed gases, usually hydrofluorocarbons and chlorofluorocarbons, which are mixed with the medicament and any necessary excipients in a pressurized container, these devices are likewise described in standard textbooks such as Sprowls and Remington.

The agents can be a free acid or base, or a pharmacologically acceptable salt thereof. Solids can be dissolved or dispersed immediately prior to administration or earlier. In some circumstances the preparations include a preservative to prevent the growth of microorganisms. The pharmaceutical forms suitable for injection can include sterile aqueous or organic solutions or dispersions which include, e.g., water, an alcohol, an organic solvent, an oil or other solvent or dispersant (e.g., glycerol, propylene glycol, polyethylene glycol, and vegetable oils). The formulations may contain antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. Pharmaceutical agents can be sterilized by filter sterilization or by other suitable means. The agent can be fused to immunoglobulins or albumin, or incorporated into a lipsome to improve half-life. The agent can also be conjugated to polyethylene glycol (PEG) chains. Methods for pegylation and additional formulations containing PEG-conjugates (i.e. PEG-based hydrogels, PEG modified liposomes) can be found in Harris and Chess, Nature Reviews Drug Discovery 2: 214-221 and the references therein. Peptides can also be modified with alkyl groups (e.g., C1-C20 straight or branched alkyl groups); fatty acid radicals; and combinations of PEG, alkyl groups and fatty acid radicals (see U.S. Pat. No. 6,309,633; Soltero et al., 2001 Innovations in Pharmaceutical Technology 106-110). The agent can be administered via a nanocochleate or cochleate delivery vehicle (BioDelivery Sciences International). The agents can be delivered transmucosally (i.e. across a mucosal surface such as the vagina, eye or nose) using formulations such as that described in U.S. Pat. No. 5,204,108. The agents can be formulated in microcapsules as described in WO 88/01165. The agent can be administered intra-orally using the formulations described in U.S. 20020055496, WO 00/47203, and U.S. Pat. No. 6,495,120. The agent can be delivered using nanoemulsion formulations described in WO 01/91728A2.

Suitable pharmaceutical compositions in accordance with the invention will generally include an amount of the active compound(s) with an acceptable pharmaceutical diluent or excipient, such as a sterile aqueous solution, to give a range of final concentrations, depending on the intended use. The techniques of preparation are generally well known in the art, as exemplified by Remington's Pharmaceutical Sciences (18th Edition, Mack Publishing Company, 1995).

The agents described herein and combination therapy agents can be packaged as a kit that includes single or multiple doses of two or more agents, each packaged or formulated individually, or single or multiple doses of two or more agents packaged or formulated in combination. Thus, one or more agents can be present in first container, and the kit can optionally include one or more agents in a second container. The container or containers are placed within a package, and the package can optionally include administration or dosage instructions. A kit can include additional components such as syringes or other means for administering the agents as well as diluents or other means for formulation.

Methods to increase chemical and/or physical stability of the agents the described herein are found in U.S. Pat. No. 6,541,606, U.S. Pat. No. 6,068,850, U.S. Pat. No. 6,124,261, U.S. Pat. No. 5,904,935, and WO 00/15224, U.S. 20030069182 (via the additon of nicotinamide), U.S. 20030175230A1, U.S. 20030175230A1, U.S. 20030175239A1, U.S. 20020045582, U.S. 20010031726, WO 02/26248, WO 03/014304, WO 98/00152A1, WO 98/00157A1, WO 90/12029, WO 00/04880, and WO 91/04743, WO 97/04796 and the references cited therein.

Methods to increase bioavailability of the agents described herein are found in U.S. Pat. No. 6,008,187, U.S. Pat. No. 5,424,289, U.S. 20030198619, WO 90/01329, WO 01/49268, WO 00/32172, and WO 02/064166. Glycyrrhizinate can also be used as an absorption enhancer (see, e.g., EP397447). WO 03/004062 discusses *Ulex europaeus* I (UEAI) and UEAI mimetics which may be used to target the agents of the invention to the GI tract.

The agents described herein can be fused to a modified version of the blood serum protein transferrin. U.S. 20030221201, U.S. 20040023334, U.S. 20030226155, WO 04/020454, and WO 04/019872 discuss the manufacture and use of transferrin fusion proteins. Transferrin fusion proteins may improve circulatory half life and efficacy, decrease undesirable side effects and allow reduced dosage.

The peptides and agonists of the invention can be recombinantly expressed in bacteria. Bacteria expressing the peptide or agonists can be administered orally, rectally, mucosally or in via some other mode of administration including but not limited to those described herein.

Analgesic Agents in Combitherapy

The peptides and agonists described herein can be used in combination therapy with an analgesic agent, e.g., an analgesic compound or an analgesic peptide. These peptides and compounds can be administered with the peptides of the invention (simultaneously or sequentially). They can also be optionally covalently linked or attached to an agent described herein to create therapeutic conjugates. Among the useful analgesic agents are: Ca channel blockers, 5HT receptor antagonists (for example 5HT3, 5HT4 and 5HT1 receptor antagonists), opioid receptor agonists (loperamide, fedotozine, and fentanyl), NK1 receptor antagonists, CCK receptor agonists (e.g., loxiglumide), NK1 receptor antagonists, NK3 receptor antagonists, norepinephrine-serotonin reuptake inhibitors (NSRI), vanilloid and cannabanoid receptor agonists, and sialorphin. Analgesics agents in the various classes are described in the literature.

Among the useful analgesic peptides are sialorphin-related peptides, including those comprising the amino acid sequence QHNPR (SEQ ID NO:85), including: VQHNPR (SEQ ID NO:86); VRQHNPR (SEQ ID NO:87); VRGQHNPR (SEQ ID NO:88); VRGPQHNPR (SEQ ID NO:89); VRGPRQHNPR (SEQ ID NO:90); VRGPRRQHNPR (SEQ ID NO:91); and RQHNPR (SEQ ID NO:92). Sialorphin-related peptides bind to neprilysin and inhibit neprilysin-mediated breakdown of substance P and Met-enkephalin. Thus, compounds or peptides that are inhibitors of neprilysin are useful analgesic agents which can be administered with the peptides of the invention in a co-therapy or linked to the peptides of the invention, e.g., by a covalent bond. Sialophin and related peptides are described in U.S. Pat. No. 6,589,750; U.S. 20030078200 A1; and WO 02/051435 A2.

Opioid receptor antagonists and agonists can be administered with the peptides of the invention in co-therapy or linked to the agent of the invention, e.g., by a covalent bond. For example, opioid receptor antagonists such as naloxone, naltrexone, methyl nalozone, nalmefene, cypridime, beta funaltrexamine, naloxonazine, naltrindole, and nor-binaltorphimine are thought to be useful in the treatment of IBS. It can be useful to formulate opioid antagonists of this type is a delayed and sustained release formulation such that initial release of the antagonist is in the mid to distal small intestine and/or ascending colon. Such antagonists are described in WO 01/32180 A2. Enkephalin pentapeptide (HOE825; Tyr-D-Lys-Gly-Phe-L-homoserine) is an agonist of the mu and delta opioid receptors and is thought to be useful for increasing intestinal motility (Eur. J. Pharm. 219:445, 1992), and this peptide can be used in conjunction with the peptides of the invention. Also useful is trimebutine which is thought to bind to mu/delta/kappa opioid receptors and activate release of motilin and modulate the release of gastrin, vasoactive intestinal peptide, gastrin and glucagons. Kappa opioid receptor agonists such as fedotozine, asimadoline, and ketocyclazocine, and compounds described in WO 03/097051 A2 can be used with or linked to the peptides of the invention. In addition, mu opioid receptor agonists such as morphine, diphenyloxylate, frakefamide (H-Tyr-D-Ala-Phe(F)-Phe-$NH_2$; WO 01/019849 A1) and loperamide can be used.

Tyr-Arg (kyotorphin) is a dipeptide that acts by stimulating the release of met-enkephalins to elicit an analgesic effect (J. Biol. Chem 262:8165, 1987). Kyotorphin can be used with or linked to the peptides of the invention.

Chromogranin-derived peptide (CgA 47-66; see, e.g., Ghia et al. 2004 Regulatory Peptides 119:199) can be used with or linked to the peptides of the invention.

CCK receptor agonists such as caerulein from amphibians and other species are useful analgesic agents that can be used with or linked to the peptides of the invention.

Conotoxin peptides represent a large class of analgesic peptides that act at voltage gated Ca channels, NMDA receptors or nicotinic receptors. These peptides can be used with or linked to the peptides of the invention.

Peptide analogs of thymulin (FR Application 2830451) can have analgesic activity and can be used with or linked to the peptides of the invention.

CCK (CCKa or CCKb) receptor antagonists, including loxiglumide and dexloxiglumide (the R-isomer of loxiglumide) (WO 88/05774) can have analgesic activity and can be used with or linked to the peptides of the invention.

Other useful analgesic agents include 5-HT4 agonists such as tegaserod (Zelnorm®), mosapride, metoclopramide, zacopride, cisapride, renzapride, benzimidazolone derivatives such as BIMU 1 and BIMU 8, and lirexapride. Such agonists are described in: EP1321142 A1, WO 03/053432 A1, EP 505322 A1, EP 505322 B1, U.S. Pat. No. 5,510,353, EP 507672 A1, EP 507672 B1, and U.S. Pat. No. 5,273,983.

Calcium channel blockers such as ziconotide and related compounds described in, for example, EP625162B1, U.S. Pat. No. 5,364,842, U.S. Pat. No. 5,587,454, U.S. Pat. No. 5,824,645, U.S. Pat. No. 5,859,186, U.S. Pat. No. 5,994,305, U.S. Pat. No. 6,087,091, U.S. Pat. No. 6,136,786, WO 93/13128A1, EP 1336409 A1, EP 835126 A1, EP 835126 B1, U.S. Pat. No. 5,795,864, U.S. Pat. No. 5,891,849, U.S. Pat. No. 6,054,429, WO 97/01351 A1, can be used with or linked to the peptides of the invention.

Various antagonists of the NK-1, NK-2, and NK-3 receptors (for a review see Giardina et al. 2003 Drugs 6:758) can be can be used with or linked to the peptides of the invention.

NK1 receptor antagonists such as: aprepitant (Merck & Co Inc), vofopitant, ezlopitant (Pfizer, Inc.), R-673 (Hoffmann-La Roche Ltd), SR-48968 (Sanofi Synthelabo), CP-122,721 (Pfizer, Inc.), GW679769 (Glaxo Smith Kline), TAK-637 (Takeda/Abbot), SR-14033, and related compounds described in, for example, EP 873753 A1, U.S. 20010006972 A1, US 20030109417A1, WO 01/52844A1, can be used with or linked to the peptides of the invention.

NK-2 receptor antagonists such as nepadutant (Menarini Ricerche SpA), saredutant (Sanofi-Synthelabo), GW597599 (Glaxo Smith Kline), SR-144190 (Sanofi-Synthelabo) and UK-290795 (Pfizer Inc) can be used with or linked to the peptides of the invention.

NK3 receptor antagonists such as osanetant (SR-142801; Sanofi-Synthelabo), SSR-241586, talnetant and related compounds described in, for example, WO 02/094187 A2, EP 876347 A1, WO 97/21680 A1, U.S. Pat. No. 6,277,862, WO 98/11090, WO 95/28418, WO 97/19927, and Boden et al. (J Med Chem. 39:1664-75, 1996) can be used with or linked to the peptides of the invention.

Norepinephrine-serotonin reuptake inhibitors (NSR1) such as milnacipran and related compounds described in WO 03/077897 A1 can be used with or linked to the peptides of the invention.

Vanilloid receptor antagonists such as arvanil and related compounds described in WO 01/64212 A1 can be used with or linked to the peptides of the invention.

The analgesic peptides and compounds can be administered with the peptides and agonists of the invention (simultaneously or sequentially). The analgesic agents can also be covalently linked to the peptides and agonists of the invention to create therapeutic conjugates. Where the analgesic is a peptide and is covalently linked to an agent described herein the resulting peptide may also include at least one trypsin cleavage site. When present within the peptide, the analgesic peptide may be preceded by (if it is at the carboxy terminus) or followed by (if it is at the amino terminus) a trypsin cleavage site that allows release of the analgesic peptide.

In addition to sialorphin-related peptides, analgesic peptides include: AspPhe, endomorphin-1, endomorphin-2, nocistatin, dalargin, lupron, ziconotide, and substance P.

Other Agents for Use in Combitherapy

Also within the invention are pharmaceutical compositions comprising a peptide or agonists of the invention and a second therapeutic agent. The second therapeutic agent can be administered to treat any condition for which it is useful, including conditions that are not considered to be the primary indication for treatment with the second therapeutic agent. The second therapeutic agent can be administered simultaneously or sequentially. The second therapeutic agent can be covalently linked to the peptides and agonists of the invention to create a therapeutic conjugate. When the second therapeutic agent is another peptide, a linker including those described herein may be used between the peptide of the invention and the second therapeutic peptide.

Examples of additional therapeutic agents to treat gastrointestinal and other disorders include:

(1) agents to treat constipation (e.g., a chloride channel activator such as the bicylic fatty acid, Lubiprostone (formerly known as SPI-0211; Sucampo Pharmaceuticals, Inc.; Bethesda, Md.), a laxative such as MiraLax; Braintree Laboratories, Braintree Mass.);

(2) acid reducing agents such as proton pump inhibitors (e.g., omeprazole (Prilosec®), esomeprazole (Nexium®), lansoprazole (Prevacid®), pantoprazole (Protonix®) and rabeprazole (Aciphex®)) and Histamine H2-receptor antagonist (also known as H2 receptor blockers including cimetidine, ranitidine, famotidine and nizatidine);

(3) prokinetic agents including metoclopramide (Reglan®), domperidone (Motilium®), erythromycin or cisapride (propulsid®)

(4) pro-motility agents such as the vasostatin-derived peptide, chromogranin A (4-16) (see, e.g., Ghia et al. 2004 Regulatory Peptides 121:31) or motilin agonists (e.g., GM-611 or mitemcinal fumarate);

(5) complete or partial 5HT (e.g. 5HT1, 5HT2, 5HT3, 5HT4) receptor agonists or antagonists (including 5HT4 receptor agonists (such as tegaserod (ZELNORM®), mosapride, metoclopramide, zacopride, cisapride, renzapride, benzimidazolone derivatives such as BIMU 1 and BIMU 8, and lirexapride. Such agonists are described in: EP1321142 A1, WO 03/053432A1, EP 505322 A1, EP 505322 B1, U.S. Pat. No. 5,510,353, EP 507672 A1, EP 507672 B1, and U.S. Pat. No. 5,273,983); 5HT3 receptor agonists such as MKC-733; and 5HT3 receptor antagonists such as alosetron and ATI-7000 (Aryx Therapeutics, Santa Clara Calif.);

(6) muscarinic receptor agonists;

(7) anti-inflammatory agents;

(8) antispasmodics;

(9) antidepressants;

(10) centrally-acting analgesic agents such as opioid receptor agonists, opioid receptor antagonists (e.g., naltrexone);

(11) agents for the treatment of Inflammatory bowel disease;

(12) agents for the treatment of Crohn's disease and/or ulcerative colitis (e.g., alequel (Enzo Biochem, Inc.; Farmingsale, N.Y.), the anti-inflammatory peptide RDP58 (Genzyme, Inc.; Cambridge, Mass.), and TRAFICET-EN™ (ChemoCentryx, Inc.; San Carlos, Calif.);

(13) agents that treat gastrointestinal or visceral pain;

(14) PDE (phosphodiesterase) inhibitors including but not limited to those disclosed herein;

(15) purgatives that draw fluids to the intestine (e.g., VISICOL®, a combination of sodium phosphate monobasic monohydrate and sodium phosphate dibasic anhydrate);

(16) Corticotropin Releasing Factor (CRF) receptor antagonists (including NBI-34041 (Neurocrine Biosciences, San Diego, Calif.), CRH9-41, astressin, R121919 (Janssen Pharmaceutica), CP154,526, NBI-27914, Antalarmin, DMP696 (Bristol-Myers Squibb) CP-316,311 (Pfizer, Inc.), GW876008 (Neurocrine/Glaxo Smith Kline), ONO-2333Ms (Ono Pharmaceuticals), TS-041 (Janssen), AAG561 (Novartis) and those disclosed in U.S. Pat. No. 5,063,245, U.S. Pat. No. 5,861,398, US20040224964, US20040198726, US20040176400, US20040171607, US20040110815, and US20040006066);

(17) glucagon-like peptides (glp-1) and analogues thereof (including exendin-4) and inhibitors of DPP-IV (DPP-IV mediates the inactivation of glp-1);

(18) tofisopam, enantiomerically-pure R-tofisopam, and pharmaceutically-acceptable salts thereof (US 20040229867)

(19) the tricyclic anti-depressant of the dibenzothiazepine type, tianeptine (Stablon®) and other agents described in U.S. Pat. No. 6,683,072;

(20) (E)-4 (1,3bis(cyclohexylmethyl)-1,2,34,-tetrahydro-2,6-diono-9H-purin-8-yl)cinnamic acid nonaethylene glycol methyl ether ester and related compounds described in WO 02/067942; and

(21) the probiotic PROBACTRIX® (The BioBalance Corporation; New York, N.Y.) which contains microorganisms useful in the treatment of gastrointestinal disorders.

The peptides and agonists of the invention can be used in combination therapy with insulin and related compounds including primate, rodent, or rabbit insulin including biologically active variants thereof including allelic variants, more preferably human insulin available in recombinant form. Sources of human insulin include pharmaceutically acceptable and sterile formulations such as those available from Eli Lilly (Indianapolis, Ind. 46285) as Humulin.™. (human insulin rDNA origin). See the THE PHYSICIAN'S DESK REFERENCE, 55.sup.th Ed. (2001) Medical Economics, Thomson Healthcare (disclosing other suitable human insulins). The peptides of the invention can also be used in combination therapy with agents that can boost insulin effects or levels of a subject upon administration, e.g. glipizide and/or rosiglitazone. The peptides and agonists of the invention can be used in combitherapy with SYMLIN® (pramlintide acetate) and Exenatide® (synthetic exendin-4; a 39 aa peptide).

The peptides and agonists of the invention can also be used in combination therapy with agents (e.g., Entereg™ (alvimopan; formerly called adolor/ADL 8-2698), conivaptan and related agents describe in U.S. Pat. No. 6,645,959) for the treatment of postoperative ileus.

The peptides and agonists of the invention can be used in combination therapy with an anti-hypertensive agent including but not limited to:

(1) diuretics, such as thiazides, including chlorthalidone, chlorthiazide, dichlorophenamide, hydroflumethiazide, indapamide, polythiazide, and hydrochlorothiazide; loop diuretics, such as bumetamide, ethacrynic acid, furosemide, and torsemide; potassium sparing agents, such as amiloride, and triamterene; and aldosterone antagonists, such as spironolactone, epirenone, and the like;

(2) beta-adrenergic blockers such as acebutolol, atenolol, betaxolol, bevantolol, bisoprolol, bopindolol, carteolol, carvedilol, celiprolol, esmolol, indenolol, metaprolol, nadolol, nebivolol, penbutolol, pindolol, propanolol, sotalol, tertatolol, tilisolol, and timolol, and the like;

(3) calcium channel blockers such as amlodipine, aranidipine, azelnidipine, barmidipine, benidipine, bepridil, cinaldipine, clevidipine, diltiazem, efonidipine, felodipine, gallopamil, isradipine, lacidipine, lemildipine, lercanidipine, nicardipine, nifedipine, nilvadipine, nimodepine, nisoldipine, nitrendipine, manidipine, pranidipine, and verapamil, and the like;

(4) angiotensin converting enzyme (ACE) inhibitors such as benazepril; captopril; ceranapril; cilazapril; delapril; enalapril; enalopril; fosinopril; imidapril; lisinopril; losinopril; moexipril; quinapril; quinaprilat; ramipril; perindopril; perindropril; quanipril; spirapril; tenocapril; trandolapril, and zofenopril, and the like;

(5) neutral endopeptidase inhibitors such as omapatrilat, cadoxatril and ecadotril, fosidotril, sampatrilat, AVE7688, ER4030, and the like;

(6) endothelin antagonists such as tezosentan, A308165, and YM62899, and the like;

(7) vasodilators such as hydralazine, clonidine, minoxidil, and nicotinyl alcohol, and the like;

(8) angiotensin II receptor antagonists such as aprosartan, candesartan, eprosartan, irbesartan, losartan, olmesartan, pratosartan, tasosartan, telmisartan, valsartan, and EXP-3137, F16828K, and RNH6270, and the like;

(9) α/β adrenergic blockers such as nipradilol, arotinolol and amosulalol, and the like;

(10) alpha 1 blockers, such as terazosin, urapidil, prazosin, tamsulosin, bunazosin, trimazosin, doxazosin, naftopidil, indoramin, WHP 164, and XEN010, and the like;

(11) alpha 2 agonists such as lofexidine, tiamenidine, moxonidine, rilmenidine and guanobenz, and the like;

(12) aldosterone inhibitors, and the like; and

(13) angiopoietin-2-binding agents such as those disclosed in WO03/030833.

The peptides and agonists of the invention can be used in combination therapy with one or more of the following agents useful in the treatment of respiratory and other disorders:

(1) β-agonists including but not limited to: albuterol (PROVENTIL®, SALBUTAMOI®, VENTOLIN®), bambuterol, bitoterol, clenbuterol, fenoterol, formoterol, isoetharine (BRONKOSOL®, BRONKOMETER®), metaproterenol (ALUPENT®, METAPREL®), pirbuterol (MAXAIR®), reproterol, rimiterol, salmeterol, terbutaline (BRETHAIRE®, BRETHINE®, BRICANYL®), adrenalin, isoproterenol (ISUPREL®), epinephrine bitartrate (PRIMATENE®), ephedrine, orciprenline, fenoterol and isoetharine;

(2) steroids, including but not limited to beclomethasone, beclomethasone dipropionate, betamethasone, budesonide, bunedoside, butixocort, dexamethasone, flunisolide, fluocortin, fluticasone, hydrocortisone, methyl prednisone, mometasone, predonisolone, predonisone, tipredane, tixocortal, triamcinolone, and triamcinolone acetonide;

(3) β2-agonist-corticosteroid combinations [e.g., salmeterol-fluticasone (ADVAIR®), formoterol-budesonid (SYMBICORT®)];

(4) leukotriene D4 receptor antagonists/leukotriene antagonists/LTD4 antagonists (i.e., any compound that is capable of blocking, inhibiting, reducing or otherwise interrupting the interaction between leukotrienes and the Cys LTI receptor) including but not limited to: zafirlukast, montelukast, montelukast sodium (SINGULAIR®), pranlukast, iralukast, pobilukast, SKB-106,203 and compounds described as having LTD4 antagonizing activity described in U.S. Pat. No. 5,565,473;

(5) 5-lipoxygenase inhibitors and/or leukotriene biosynthesis inhibitors [e.g., zileuton and BAY1005 (CA registry 128253-31-6)];

(6) histamine H1 receptor antagonists/antihistamines (i.e., any compound that is capable of blocking, inhibiting, reducing or otherwise interrupting the interaction between histamine and its receptor) including but not limited to: astemizole, acrivastine, antazoline, azatadine, azelastine, astamizole, bromopheniramine, bromopheniramine maleate, carbinoxamine, carebastine, cetirizine, chlorpheniramine, chloropheniramine maleate, cimetidine , clemastine, cyclizine, cyproheptadine, descarboethoxyloratadine, dexchlorpheniramine, dimethindene, diphenhydramine, diphenylpyraline, doxylamine succinate, doxylamine, ebastine, efletirizine, epinastine, famotidine, fexofenadine, hydroxyzine, hydroxyzine, ketotifen, levocabastine, levocetirizine, levocetirizine, loratadine, meclizine, mepyramine, mequitazine, methdilazine, mianserin, mizolastine, noberastine, norastemizole, noraztemizole, phenindamine, pheniramine, picumast, promethazine, pynlamine, pyrilamine, ranitidine, temelastine, terfenadine, trimeprazine, tripelenamine, and triprolidine;

(7) an anticholinergic including but not limited to: atropine, benztropine, biperiden, flutropium, hyoscyamine, ilutropium, ipratropium, ipratropium bromide, methscopolamine, oxybutinin, rispenzepine, scopolamine, and tiotropium;

(8) an anti-tussive including but not limited to: dextromethorphan, codeine, and hydromorphone;

(9) a decongestant including but not limited to: pseudoephedrine and phenylpropanolamine;

(10) an expectorant including but not limited to: guafenesin, guaicolsulfate, terpin, ammonium chloride, glycerol guaicolate, and iodinated glycerol;

(11) a bronchodilator including but not limited to: theophylline and aminophylline;

(12) an anti-inflammatory including but not limited to: fluribiprofen, diclophenac, indomethacin, ketoprofen, S-ketroprophen, tenoxicam;

(13) a PDE (phosphodiesterase) inhibitor including but not limited to those disclosed herein;

(14) a recombinant humanized monoclonal antibody [e.g. xolair (also called omalizumab), rhuMab, and talizumab];

(15) a humanized lung surfactant including recombinant forms of surfactant proteins SP-B, SP-C or SP-D [e.g. SURFAXIN®, formerly known as dsc-104 (Discovery Laboratories)],

(16) agents that inhibit epithelial sodium channels (ENaC) such as amiloride and related compounds;

(17) antimicrobial agents used to treat pulmonary infections such as acyclovir, amikacin, amoxicillin, doxycycline, trimethoprin sulfamethoxazole, amphotericin B, azithromycin, clarithromycin, roxithromycin, clarithromycin, cephalosporins(ceffoxitin, cefmetazole etc), ciprofloxacin, ethambutol, gentimycin, ganciclovir, imipenem, isoniazid, itraconazole, penicillin, ribavirin, rifampin, rifabutin, amantadine, rimantidine, streptomycin, tobramycin, and vancomycin;

(18) agents that activate chloride secretion through Ca++ dependent chloride channels (such as purinergic receptor (P2Y(2) agonists);

(19) agents that decrease sputum viscosity, such as human recombinant DNase 1, (Pulmozyme®);

(20) nonsteroidal anti-inflammatory agents (acemetacin, acetaminophen, acetyl salicylic acid, alclofenac, alminoprofen, apazone, aspirin, benoxaprofen, bezpiperylon, bucloxic acid, carprofen, clidanac, diclofenac, diclofenac, diflunisal, diflusinal, etodolac, fenbufen, fenbufen, fenclofenac, fenclozic acid, fenoprofen, fentiazac, feprazone, flufenamic acid, flufenisal, flufenisal, fluprofen, flurbiprofen, flurbiprofen, furofenac, ibufenac, ibuprofen, indomethacin, indomethacin, indoprofen, isoxepac, isoxicam, ketoprofen, ketoprofen, ketorolac, meclofenamic acid, meclofenamic acid, mefenamic acid, mefenamic acid, miroprofen, mofebutazone, nabumetone oxaprozin, naproxen, naproxen, niflumic acid, oxaprozin, oxpinac, oxyphenbutazone, phenacetin, phenylbutazone, phenylbutazone, piroxicam, piroxicam, pirprofen, pranoprofen, sudoxicam, tenoxican, sulfasalazine, sulindac, sulindac, suprofen, tiaprofenic acid, tiopinac, tioxaprofen, tolfenamic acid, tolmetin, tolmetin, zidometacin, zomepirac, and zomepirac); and

(21) aerosolized antioxidant therapeutics such as S-Nitrosoglutathione.

The peptides and agonists of the invention can be used in combination therapy with an anti-obesity agent including but not limited to:

(1) 11β HSD-1 (11-beta hydroxy steroid dehydrogenase type 1) inhibitors, such as BVT 3498, BVT 2733, 3-(1-adamantyl)-4-ethyl-5-(ethylthio)-4H-1,2,4-triazole, 3-(1-adamantyl)-5-(3,4,5-trimethoxyphenyl)-4-methyl-4H-1,2,4-triazole, 3-adamantanyl-4,5,6,7,8,9,10,11,12,3a-decahydro-1,2,4-triazolo[4,3-a][11]annulene, and those compounds disclosed in WO01/90091, WO01/90090, WO01/90092 and WO02/072084;
(2) 5HT (serotonin) transporter inhibitors, such as paroxetine, fluoxetine (Prozac®), fenfluramine, fluvoxamine, sertraline, and imipramine, and those disclosed in WO03/00663;
(3) 5HT antagonists such as those in WO03/037871, WO03/037887, and the like;
(4) 5HT1a modulators such as those disclosed in WO03/031439, and the like;
(5) 5HT-2 agonists;
(6) 5HT2c (serotonin receptor 2c) agonists, such as BVT933, DPCA37215, IK264, PNU 22394, WAY161503, R-1065, SB 243213 (Glaxo Smith Kline) and YM 348 and those disclosed in U.S. Pat. No. 3,914,250 and PCT publication Nos. WO02/36596, WO02/48124, WO02/10169, WO01/66548, WO02/44152, WO02/51844, WO02/40456, and WO02/40457;
(7) 5HT6 receptor modulators, such as those in WO03/030901, WO03/035061, WO03/039547, and the like;
(8) ACC2 (acetyl-CoA carboxylase-2) inhibitors;
(9) acyl-estrogens, such as oleoyl-estrone, disclosed in del Mar-Grasa, M. et al., Obesity Research, 9:202-9 (2001) and Japanese Patent Application No. JP 2000256190;
(10) alpha-lipoic acid (alpha-LA);
(11) anorectic bicyclic compounds such as 1426 (Aventis) and 1954 (Aventis), and the compounds disclosed in WO00/18749, WO01/32638, WO01/62746, WO01/62747, and WO03/015769;
(12) AOD9604;
(13) appetite suppressants such as those in WO03/40107;
(14) ATL-962 (Alizyme PLC);
(15) benzocaine;
(16) benzphetamine hydrochloride (Didrex);
(17) bladderwrack (focus vesiculosus);
(18) BRS3 (bombesin receptor subtype 3) agonists;
(19) bupropion;
(20) caffeine;
(21) CB 1 (cannabinoid-1 receptor) antagonist/inverse agonists, such as rimonabant (Acomplia; Sanofi Synthelabo), SR-147778 (Sanofi Synthelabo), BAY 65-2520 (Bayer), and SLV 319 (Solvay), and those disclosed in U.S. Pat. Nos. 4,973,587, 5,013,837, 5,081,122, 5,112,820, 5,292,736, 5,532,237, 5,624,941, 6,028,084, and 6,509,367 and WO96/33159, WO97/29079, WO98/31227, WO98/33765, WO98/37061, WO98/41519, WO98/43635, WO98/43636, WO99/02499, WO00/10967, WO00/10968, WO01/09120, WO01/58869, WO01/64632, WO01/64633, WO01/64634, WO01/70700, WO01/96330, WO02/076949, WO03/006007, WO03/007887, WO03/020217, WO03/026647, WO03/026648, WO03/027069, WO03/027076, WO03/027114, WO03/037332, WO03/040107, WO03/086940, WO03/084943 and U.S. Pat. No. 6,509,367 and EPO Application No. EP-658546;
(22) CCK agonists;
(23) CCK-A (cholecystokinin-A) agonists, such as AR-R 15849, GI 181771, JMV-180, A-71378, A-71623 and SR146131, and those described in U.S. Pat. No. 5,739,106;
(24) chitosan;
(25) chromium;
(26) CNTF (Ciliary neurotrophic factors), such as GI-181771 (Glaxo-SmithKline), SR146131 (Sanofi Synthelabo), butabindide, PD170,292, and PD 149164 (Pfizer);
(27) CNTF derivatives, such as axokine (Regeneron), and those disclosed in PCT Application Nos. WO 94/09134, WO 98/22128, and WO 99/43813;
(28) conjugated linoleic acid;
(29) corticotropin-releasing hormone agonists;
(30) dehydroepiandrosterone;
(31) DGAT1 (diacylglycerol acyltransferase 1) inhibitors;
(32) DGAT2 (diacylglycerol acyltransferase 2) inhibitors;
(33) dicarboxylate transporter inhibitors;
(34) diethylpropion hydrochloride (Tenuate);
(35) dipeptidyl peptidase IV (DP-IV) inhibitors, such as isoleucine thiazolidide, valine pyrrolidide, NVP-DPP728, LAF237, P93/01, TSL 225, TMC-2A/2B/2C, FE 999011, P93101/K364, VIP 0177, SDZ 274-444 and the compounds disclosed in PCT publication Nos. WO02/083128, WO02/062764, WO03/000180, WO03/000181, WO03/000250, WO03/002530, WO03/002531, WO03/002553, WO03/002593, WO03/004498, WO03/004496, WO03/017936, WO03/024942, WO03/024965, WO03/033524, WO03/037327 and EP1258476;
(36) ephedra;
(37) exendin-4 (an inhibitor of glp-1)
(38) FAS (fatty acid synthase) inhibitors, such as Cerulenin and C75;
(39) fat resorption inhibitors such as those in WO03/053451, and the like;
(40) fatty acid transporter inhibitors;
(41) fiber (psyllium, *plantago*, guar fiber);
(42) galanin antagonists;
(43) galega (Goat's Rue, French Lilac);
(44) *garcinia cambogia;*
(45) germander (teucrium chamaedrys);
(46) ghrelin antagonists, such as those disclosed in PCT Application Nos. WO 01/87335, and WO 02/08250;
(47) GLP-1 (glucagon-like peptide 1) agonists (e.g. exendin-4);
(48) glp-1 (glucagon-like peptide-1);
(49) glucocorticoid antagonists;
(50) glucose transporter inhibitors;
(51) growth hormone secretagogue receptor agonists/antagonists, s such as NN703, hexarelin, MK-0677, SM-130686, CP-424,391, L-692,429 and L-163,255, and such as those disclosed in U.S. Pat. No. 6,358,951, U.S. Patent Application Nos. 2002/049196 and 2002/022637, and PCT Application Nos. WO 01/56592 and WO 02/32888;
(52) growth hormone secretagogues, such as those disclosed and specifically described in U.S. Pat. No. 5,536,716;
(53) H3 (histamine H3) antagonist/inverse agonists, such as thioperamide, 3-(1H-imidazol-4-yl)propyl N-(4-pentenyl) carbamate), clobenpropit, iodophenpropit, imoproxifan, GT2394 (Gliatech), and A331440, and those disclosed in PCT publication No. WO02/15905 and O-[3-(1H-imidazol-4-yl)propanol]carbamates (Kiec-Kononowicz, K. et al., Pharmazie, 55:349-55 (2000)), piperidine-containing histamine H3-receptor antagonists (Lazewska, D. et al., Pharmazie, 56:927-32 (2001), benzophenone derivatives and related compounds (Sasse, A. et al., Arch. Pharm. (Weinheim) 334:45-52 (2001)), substituted N-phenylcarbamates (Reidemeister, S. et al., Pharmazie, 55:83-6 (2000)), and proxifan derivatives (Sasse, A. et al., J. Med. Chem. 43:3335-43 (2000)) and histamine H3 receptor modulators such as those disclosed in WO03/024928 and WO03/024929;

(54) interleukin-6 (IL-6) and modulators thereof, as in WO03/057237, and the like;

(55) L-carnitine;

(56) leptin derivatives, such as those disclosed in U.S. Pat. Nos. 5,552,524, 5,552,523, 5,552,522, 5,521,283, and PCT International Publication Nos. WO 96/23513, WO 96/23514, WO 96/23515, WO 96/23516, WO 96/23517, WO 96/23518, WO 96/23519, and WO 96/23520;

(57) leptin, including recombinant human leptin (PEG-OB, Hoffman La Roche) and recombinant methionyl human leptin (Amgen);

(58) lipase inhibitors, such as tetrahydrolipstatin (orlistat/Xenical®), Triton WR1339, RHC80267, lipstatin, teasaponin, and diethylumbelliferyl phosphate, FL-386, WAY-121898, Bay-N-3176, valilactone, esteracin, ebelactone A, ebelactone B, and RHC 80267, and those disclosed in PCT publication No. WO01/77094, and U.S. Pat. Nos. 4,598,089, 4,452,813, 5,512,565, 5,391,571, 5,602,151, 4,405,644, 4,189,438, and 4,242,453;

(59) lipid metabolism modulators such as maslinic acid, erythrodiol, ursolic acid uvaol, betulinic acid, betulin, and the like and compounds disclosed in WO03/011267;

(60) Mc3r (melanocortin 3 receptor) agonists;

(61) Mc4r (melanocortin 4 receptor) agonists, such as CHIR86036 (Chiron), ME-10142, ME-10145, and HS-131 (Melacure), and those disclosed in PCT publication Nos. WO99/64002, WO00/74679, WO01/991752, WO01/25192, WO01/52880, WO01/74844, WO01/70708, WO01/70337, WO01/91752, WO02/059095, WO02/059107, WO02/059108, WO02/059117, WO02/06276, WO02/12166, WO02/11715, WO02/12178, WO02/15909, WO02/38544, WO02/068387, WO02/068388, WO02/067869, WO02/081430, WO03/06604, WO03/007949, WO03/009847, WO03/009850, WO03/013509, and WO03/031410;

(62) Mc5r (melanocortin 5 receptor) modulators, such as those disclosed in WO97/19952, WO00/15826, WO00/15790, US 20030092041;

(63) MCH2R (melanin concentrating hormone 2R) agonist/antagonists;

(64) melanin concentrating hormone antagonists;

(65) melanin-concentrating hormone 1 receptor (MCHR) antagonists, such as T-226296 (Takeda), SNP-7941 (Synaptic), and those disclosed WO01/21169, WO01/82925, WO01/87834, WO02/051809, WO02/06245, WO02/076929, WO02/076947, WO02/04433, WO02/51809, WO02/083134, WO02/094799, WO03/004027, WO03/13574, WO03/15769, WO03/028641, WO03/035624, WO03/033476, WO03/033480 and Japanese Patent Application Nos. JP 13226269, and JP1437059;

(66) melanocortin agonists, such as Melanotan II or those described in WO 99/64002 and WO 00/74679;

(67) Metformin (GLUCOPHAGE®);

(68) mGluR5 modulators such as those disclosed in WO03/029210, WO03/047581, WO03/048137, WO03/051315, WO03/051833, WO03/053922, WO03/059904, and the like;

(69) monoamine reuptake inhibitors, such as sibutratmine (Meridia®/Reductil®) and salts thereof, and those compounds disclosed in U.S. Pat. Nos. 4,746,680, 4,806,570, and 5,436,272, and U.S. Patent Publication No. 2002/0006964, and WO01/27068, and WO01/62341;

(70) NE (norepinephrine) transport inhibitors, such as GW 320659, despiramine, talsupram, and nomifensine;

(71) nomame herba;

(72) non-selective serotonin/norepinephrine transport inhibitors, such as sibutramine or fenfluramine;

(73) NPY 1 antagonists, such as BIBP3226, J-115814, BIBO 3304, LY-357897, CP-671906, GI-264879A, and those disclosed in U.S. Pat. No. 6,001,836, and PCT Patent Publication Nos. WO 96/14307, WO 01/23387, WO 99/51600, WO 01/85690, WO 01/85098, WO 01/85173, and WO 01/89528;

(74) NPY5 (neuropeptide Y Y5) antagonists, such as 152,804, GW-569180A, GW-594884A, GW-587081X, GW-548118X, FR235208, FR226928, FR240662, FR252384, 1229U91, GI-264879A, CGP71683A, LY-377897, LY-366377, PD-160170, SR-120562A, SR-120819A, JCF-104, and H409/22 and those compounds disclosed in U.S. Pat. Nos. 6,140,354, 6,191,160, 6,258,837, 6,313,298, 6,326,375, 6,329,395, 6,335,345, 6,337,332, 6,329,395, and 6,340,683, European Patent Nos. EP-01010691, and EP-01044970 and PCT Publication Nos. WO97/19682, WO97/20820, WO97/20821, WO97/20822, WO97/20823, WO98/27063, WO00/107409, WO00/185714, WO00/185730, WO00/64880, WO00/68197, WO00/69849, WO01/09120, WO01/14376, WO01/85714, WO01/85730, WO01/07409, WO01/02379, WO01/23388, WO01/23389, WO01/44201, WO01/62737, WO01/62738, WO01/09120, WO02/20488, WO02/22592, WO02/48152, WO02/49648, WO02/051806, WO02/094789, WO03/009845, WO03/014083, WO03/022849, WO03/028726 and Norman et al., J. Med. Chem. 43:4288-4312 (2000);

(75) opioid antagonists, such as nalmefene (REVEX®), 3-methoxynaltrexone, naloxone, and naltrexone and those disclosed in WO00/21509;

(76) orexin antagonists, such as SB-334867-A and those disclosed in PCT publication Nos. WO01/96302, WO01/68609, WO02/44172, WO02/51232, WO02/51838, WO02/089800, WO02/090355, WO03/023561, WO03/032991, and WO03/037847;

(77) PDE (phosphodiesterase) inhibitors including but not limited to those disclosed herein;

(78) peptide YY and fragments and variants thereof (e.g. YY3-36 (PYY3-36)(N. Engl. J. Med. 349:941, 2003; IKPEAPGE DASPEELNRY YASLRHYLNL VTRQRY (SEQ ID NO:8623)) and PYY agonists such as those disclosed in WO03/026591;

(79) phendimetrazine;

(80) phentermine,

(81) phosphate transporter inhibitors;

(82) phosphodiesterase-3B (PDE3B) inhibitors;

(83) phytopharm compound 57 (CP 644,673);

(84) pyruvate;

(85) SCD-1 (stearoyl-CoA desaturase-1) inhibitors;

(86) serotonin reuptake inhibitors, such as dexfenfluramine, fluoxetine, and those in U.S. Pat. No. 6,365,633, and WO01/27060, and WO0/162341;

(87) T71 (Tularik; Inc.; Boulder Colo.);

(88) thyroid hormone β agonists, such as KB-2611 (KaroBioBMS), and those disclosed in WO02/15845 and Japanese Patent Application No. JP 2000256190;
(89) Topiramate (TOPIMAX®);
(90) transcription factor modulators such as those disclosed in WO03/026576;
(91) UCP-1 (uncoupling protein-1), 2, or 3 activators, such as phytanic acid, 4-[(E)-2-(5,6,7,8-tetrahydro-5,5,8,8-tetramethyl-2-napthalenyl)-1-propeny-1]benzoic acid (TTNPB), retinoic acid, and those disclosed in PCT Patent Application No. WO 99/00123;
(92) β3 (beta adrenergic receptor 3) agonists, such as AD9677/TAK677 (Dainippon/Takeda), CL-316,243, SB 418790, BRL-37344, L-796568, BMS-196085, BRL-35135A, CGP12177A, BTA-243, GW 427353, Trecadrine, Zeneca D7114, N-5984 (Nisshin Kyorin), LY-377604 (Lilly), and SR 59119A, and those disclosed in U.S. Pat. No. 5,705,515, U.S. Pat. No. 5,451,677 and PCT publication Nos. WO94/18161, WO95/29159, WO97/46556, WO98/04526 and WO98/32753, WO01/74782, WO02/32897, WO03/014113, WO03/016276, WO03/016307, WO03/024948, WO03/024953 and WO03/037881;
(93) β-hydroxy steroid dehydrogenase-1 inhibitors (β-HSD-1) and
(94) β-hydroxy-β-methylbutyrate.

Peptides and agonists of the invention useful in the treatment of obesity can be administered as a cotherapy with electrostimulation (US20040015201).

The peptides and agonists of the invention can be used in combination therapy with agents that activate soluble guanylate cyclase, for example those described in US20040192680.

The peptides and agonists of the invention can be used in combination therapy with a phosphodiesterase inhibitor. PDE inhibitors within the meaning of the present invention are those compounds which slow the degradation of cyclic AMP (cAMP) and/or cyclic GMP (cGMP) by inhibition of the phosphodiesterases, which can lead to a relative increase in the intracellular concentration of cAMP and cGMP. Possible PDE inhibitors within the meaning of the present invention are primarily those substances which are to be numbered among the class consisting of the PDE3 inhibitors, the class consisting of the PDE4 inhibitors and/or the class consisting of the PDE5 inhibitors, in particular those substances which can be designated as mixed types of PDE3/4 inhibitors or as mixed types of PDE3/4/5 inhibitors. By way of example, those PDE inhibitors may be mentioned such as are described and/or claimed in the following patent applications and patents: DE1470341, DE2108438, DE2123328, DE2305339, DE2305575, DE2315801, DE2402908, DE2413935, DE2451417, DE2459090, DE2646469, DE2727481, DE2825048, DE2837161, DE2845220, DE2847621, DE2934747, DE3021792, DE3038166, DE3044568, EP000718, EP0008408, EP0010759, EP0059948, EP0075436, EP0096517, EP0112987, EP0116948, EP0150937, EP0158380, EP0161632, EP0161918, EP0167121, EP0199127, EP0220044, EP0247725, EP0258191, EP0272910, EP0272914, EP0294647, EP0300726, EP0335386, EP0357788, EP0389282, EP0406958, EP0426180, EP0428302, EP0435811, EP0470805, EP0482208, EP0490823, EP0506194, EP0511865, EP0527117, EP0626939, EP0664289, EP0671389, EP0685474, EP0685475, EP0685479, JP92234389, JP94329652, JP95010875, U.S. Pat. Nos. 4,963,561, 5,141,931, WO9117991, WO9200968, WO9212961, WO9307146, WO9315044, WO9315045, WO9318024, WO9319068, WO9319720, WO9319747, WO9319749, WO9319751, WO9325517, WO9402465, WO9406423, WO9412461, WO9420455, WO9422852, WO9425437, WO9427947, WO9500516, WO9501980, WO9503794, WO9504045, WO9504046, WO9505386, WO9508534, WO9509623, WO9509624, WO9509627, WO9509836, WO9514667, WO9514680, WO9514681, WO9517392, WO9517399, WO9519362, WO9522520, WO9524381, WO9527692, WO9528926, WO9535281, WO9535282, WO9600218, WO9601825, WO9602541, WO9611917, DE3142982, DE1116676, DE2162096, EP0293063, EP0463756, EP0482208, EP0579496, EP0667345 U.S. Pat. No. 6,331,543, US20050004222 (including those disclosed in formulas I-XIII and paragraphs 37-39, 85-0545 and 557-577) and WO9307124, EP0163965, EP0393500, EP0510562, EP0553174, WO9501338 and WO9603399. PDE5 inhibitors which may be mentioned by way of example are RX-RA-69, SCH-51866, KT-734, vesnarinone, zaprinast, SKF-96231, ER-21355, BF/GP-385, NM-702 and sildenafil (Viagra®). PDE4 inhibitors which may be mentioned by way of example are RO-20-1724, MEM 1414 (R1533/R1500; Pharmacia Roche), DENBUFYLLINE, ROLIPRAM, OXAGRELATE, NITRAQUAZONE, Y-590, DH-6471, SKF-94120, MOTAPIZONE, LIXAZINONE, INDOLIDAN, OLPRINONE, ATIZORAM, KS-506-G, DIPAMFYLLINE, BMY-43351, ATIZORAM, AROFYLLINE, FILAMINAST, PDB-093, UCB-29646, CDP-840, SKF-107806, PICLAMILAST, RS-17597, RS-25344-000, SB-207499, TIBENELAST, SB-210667, SB-211572, SB-211600, SB-212066, SB-212179, GW-3600, CDP-840, MOPIDAMOL, ANAGRELIDE, IBUDILAST, AMRINONE, PIMOBENDAN, CILOSTAZOL, QUAZINONE and N-(3,5-dichloropyrid-4-yl)-3-cyclopropylmethoxy4-difluoromethoxybenzamide. PDE3 inhibitors which may be mentioned by way of example are SULMAZOLE, AMPIZONE, CILOSTAMIDE, CARBAZERAN, PIROXIMONE, IMAZODAN, CI-930, SIGUAZODAN, ADIBENDAN, SATERINONE, SKF-95654, SDZ-MKS-492, 349-U-85, EMORADAN, EMD-53998, EMD-57033, NSP-306, NSP-307, REVIZINONE, NM-702, WIN-62582 and WIN-63291, ENOXIMONE and MILRINONE. PDE3/4 inhibitors which may be mentioned by way of example are BENAFENTRINE, TREQUINSIN, ORG-30029, ZARDAVERINE, L-686398, SDZ-ISQ-844, ORG-20241, EMD-54622, and TOLAFENTRINE. Other PDE inhibitors include: cilomilast, pentoxifylline, roflumilast, tadalafil(Cialis®), theophylline, and vardenafil(Levitra®), zaprinast (PDE5 specific).

Methods of Treatment

A number of disorders can possibly be treated with GC-C receptor agonists and agents that increase cGMP levels including the peptides and agonists of the invention.

The peptides and agonists of the invention can be used alone or in combination therapy for the treatment or prevention of congestive heart failure. Such agents can be used in combination with natriuretic peptides (e.g., atrial natriuretic peptide, brain natriuretic peptide or C-type natriuretic peptide), a diuretic, or an inhibitor of angiotensin converting enzyme.

The peptides and agonists of the invention can be used alone or in combination therapy for the treatment or prevention of benign prostatic hyperplasia (BPH). Such agents can be used in combination with one or more agents for treatment of BPH, for example, a 5-alpha reductase inhibitor (e.g., finasteride) or an alpha adrenergic inhibitor (e.g., doxazosine).

The peptides and agonists of the invention can be used alone or in combination therapy for the treatment, prevention or reduction of visceral pain associated with a gastrointestinal disorder or pain associated with another disorder.

The peptides and agonists of the invention can be used alone or in combination therapy for the treatment or prevention of obesity-related disorders (e.g. disorders that are associated with, caused by, or result from obesity). Examples of obesity-related disorders include overeating and bulimia, hypertension, diabetes, elevated plasma insulin concentrations and insulin resistance, dyslipidemias, hyperlipidemia, endometrial, breast, prostate and colon cancer, osteoarthritis, obstructive sleep apnea, cholelithiasis, gallstones, heart disease, abnormal heart rhythms and arrhythmias, myocardial infarction, congestive heart failure, coronary heart disease, sudden death, stroke, polycystic ovarian disease, craniopharyngioma, the Prader-Willi Syndrome, Frohlich's syndrome, GH-deficient subjects, normal variant short stature, Turner's syndrome, and other pathological conditions showing reduced metabolic activity or a decrease in resting energy expenditure as a percentage of total fat-free mass, e.g., children with acute lymphoblastic leukemia. The agents of the invention may be used to reduce or control body weight (or fat) or to prevent and/or treat obesity or other appetite related disorders related to the excess consumption of food, ethanol and other appetizing substances. The agents may be used to modulate lipid metabolism, reduce body fat (e.g. via increasing fat utilization) or reduce (or suppress) appetite (e.g. via inducing satiety). Further examples of obesity-related disorders are metabolic syndrome, also known as syndrome X, insulin resistance syndrome, sexual and reproductive dysfunction, such as infertility, hypogonadism in males and hirsutism in females, gastrointestinal motility disorders, such as obesity-related gastroesophageal reflux, respiratory disorders, such as obesity-hypoventilation syndrome (Pickwickian syndrome), cardiovascular disorders, inflammation, such as systemic inflammation of the vasculature, arteriosclerosis, hypercholesterolemia, hyperuricaemia, lower back pain, gallbladder disease, gout, and kidney cancer. The agents of the present invention are also useful for reducing the risk of secondary outcomes of obesity, such as reducing the risk of left ventricular hypertrophy.

The peptides and agonists of the invention can be used alone or in combination therapy for the treatment or prevention of gastrointestinal related disorders including: chronic intestinal pseudo-obstruction (Ogilvie's syndrome), colonic pseudoobstruction, Crohn's disease, dyspepsia (including functional dyspepsia or nonulcer dyspepsia), duodenogastric reflux, functional bowel disorder, functional gastrointestinal disorders, functional heartburn, gastroesophageal reflux disease (GERD), gastrointestinal motility disorders, gastroparesis (e.g. idopathic gastroparesis), hypertrophic pyloric stenosis, Inflammatory bowel disease, irritable bowel syndrome (IBS), post-operative ileus, and ulcerative colitis. The peptides and agonists of the invention can be used alone or in combination therapy to patient suffering from or susceptible to GI disorders relating to damage to the GI tract stemming from impact or surgical intervention. The peptides and agonists of the invention can be used alone or in combination therapy to patients at risk for or having particular diseases associated with hypomotility or stasis in the GI tract. For example, diabetic neuropathy, anorexia nervosa, and achlorhydria are frequently accompanied by gastric hypomotility. Damage to the GI tract following surgical intervention, for instance, can result in substantial gastric stasis. The peptides and agonists of the invention can be administered alone or in combination therapy to patients susceptible to or having a GI disorder associated with diabetes (e.g. diabetic gastropathy). The peptides and agonists of the invention can be used alone or in combination therapy to prevent and/or treat GI disorders characterized by at least one of nausea, vomiting, heartburn, postprandial discomfort, diarrhea, constipation, indigestion or related symptoms. The peptides and agonists of the invention can be used alone or in combination therapy to prevent and/or treat GI disorders associated with at least one of diabetes, anorexia nervosa, bulimia, achlorhydria, achalasia, anal fissure, irritable bowel syndrome, intestinal pseudoobstruction, scleroderma and gastrointestinal damage.

The peptides and agonists of the invention can be used to prevent and/or treat constipation (e.g. constipation associated with use of a therapeutic agent; constipation associated with a neuropathic, metabolic or endocrine disorder (including autonomic neuropathy, Chagas disease, cystic fibrosis, diabetes mellitus, Hirschsprung disease, hyperthyroidism, hypocalcaemia, hypothyroidism, Multiple Sclerosis, neurofibromatosis, Parkinson's disease, and spinal cord lesions); post-surgical constipation (postoperative ileus); constipation associated with a gastrointestinal disorder; idiopathic constipation (functional constipation or slow transit constipation); constipation associated with the use of analgesic drugs (e.g. opioid induced constipation); constipation associated with the use of other agents (e.g. antihypertensives, anticonvulsants, antidepressants, antispasmodics and antipsychotics); megacolon; and chronic constipation).

The peptides and agonists of the invention can be used to treat decreased intestinal motility, slow digestion or slow stomach emptying. The peptides and agonists can be used to relieve one or more symptoms of IBS (bloating, pain, constipation), GERD (acid reflux into the esophagus), duodenogastric reflux, functional dyspepsia, or gastroparesis (nausea, vomiting, bloating, delayed gastric emptying) and other disorders described herein.

The peptides and agonists of the invention can be used to increase intestinal motility and to prevent and/or treat gastrointestinal immotility and other conditions calling for laxative or stool softener therapy. Gastrointestinal immotility can include constipation, and also includes delayed oral cecal transit time, irregular Taxation, and other related gastrointestinal motility disfunction including impaction. Impaction is a condition where a large mass of dry, hard stool develops in the rectum, often due to chronic constipation. This mass may be so hard that it cannot be excreted. The subjects affected by constipation or gastrointestinal immotility can be refractory to laxative therapy and/or stool softener therapy.

The peptides and agonists of the invention can be used for the treatment or prevention of cancer, pre-cancerous growths, or metastatic growths. For example, they can be used for the prevention or treatment of: colorectal/local metastasized colorectal cancer, intestinal polyps, gastrointestinal tract cancer, lung cancer, cancer or pre-cancerous growths or metastatic growths of epithelial cells, polyps, breast, colorectal, lung, ovarian, pancreatic, prostatic, renal, stomach, bladder, liver, esophageal and testicular carcinoma, carcinoma (e.g., basal cell, basosquamous, Brown-Pearce, ductal carcinoma, Ehrlich tumor, Krebs, Merkel cell, small or non-small cell lung, oat cell, papillary, bronchiolar, squamous cell, transitional cell, (Walker), leukemia (e.g., B-cell, T-cell, HTLV, acute or chronic lymphocytic, mast cell, myeloid), histiocytonia, histiocytosis, Hodgkin's disease, non-Hodgkin's lymphoma, plasmacytoma, reticuloendotheliosis, adenoma, adeno-carcinoma, adenofibroma, adenolymphoma, ameloblastoma, angiokeratoma, angiolymphoid hyperplasia with eosinophilia, sclerosing angioma, angiomatosis, apudoma, branchionia, malignant carcinoid syndrome, carcinoid heart disease, carcinosarcoma, cementoma, cholangioma, cholesteatoma, chondrosarcoma, chondroblastoma, chondrosarcoma, chordoma, choristoma, craniopharyngioma, chrondroma, cylindroma, cystadenocarcinoma, cystadenoma, cystosarconia phyllodes, dysgenninoma, ependymoma, Ewing sarcoma, fibroma, fibrosarcoma, giant cell tumor, ganglioneuroma, glioblastoma, glomangioma, granulosa cell tumor, gynandroblastoma, hamartoma, hemangioendothelioma, hemangioma, hemangio-pericytoma, hemangiosarcoma, hepatoma, islet cell tumor, Kaposi sarcoma, leiomyoma, leiomyosarcoma, leukosarcoma, Leydig cell tumor, lipoma, liposarcoma, lymphaugioma, lymphangiomyoma, lymphangiosarcoma, medulloblastoma, meningioma, mesenchymoma, mesonephroma, mesothelioma, myoblastoma, myoma, myosarcoma, myxoma, myxosarcoma, neurilemmoma, neuroma, neuroblastoma, neuroepithelioma, neurofibroma, neurofibromatosis, odontoma, osteoma, osteosarcoma, papilloma, paraganglioma, paraganglionia. nonchroinaffin, pinealoma, rhabdomyoma, rhabdomyosarcoma, Sertoli cell tumor, teratoma, theca cell tumor, and other diseases in which cells have become dysplastic, immortalized, or transformed.

The peptides and agonists of the invention can be used for the treatment or prevention of: Familial Adenomatous Polyposis (FAP) (autosomal dominant syndrome) that precedes colon cancer, hereditary nonpolyposis colorectal cancer (HNPCC), and inherited autosomal dominant syndrome.

For treatment or prevention of cancer, pre-cancerous growths and metastatic growths, the peptides and agonists of the invention can be used in combination therapy with radiation or chemotherapeutic agents, an inhibitor of a cGMP-dependent phosphodiesterase or a selective cyclooxygenase-2 inhibitor. A number of selective cyclooxygenase-2 inhibitors are described in US20010024664, U.S. Pat. No. 5,380,738, U.S. Pat. No. 5,344,991, U.S. Pat. No. 5,393,790, U.S. Pat. No. 5,434,178, U.S. Pat. No. 5,474,995, U.S. Pat. No. 5,510,368, WO02/062369, WO 96/06840, WO 96/03388, WO 96/03387, WO 96/19469, WO 96/25405, WO 95/15316, WO 94/15932, WO 94/27980, WO 95/00501, WO 94/13635, WO 94/20480, and WO 94/26731, the disclosures of which are herein incorporated by reference. [Pyrazol-1-yl] benzenesulfonamides have also been described as inhibitors of cyclooxygenase-2. The peptides and agonists of the invention can be used in the treatment or prevention of inflammation. Thus, they can be used alone or in combination with an inhibitor of cGMP-dependent phosphodiesterase or a selective cyclooxygenase-2 inhibitor for treatment of: organ inflammation, IBD (e.g., Crohn's disease, ulcerative colitis), asthma, nephritis, hepatitis, pancreatitis, bronchitis, cystic fibrosis, ischemic bowel diseases, intestinal inflammations/allergies, coeliac disease, proctitis, eosnophilic gastroenteritis, mastocytosis, and other inflammatory disorders. The peptides and agonists of the invention can be used alone or in combination therapy in the treatment or prevention of gastrointestinal tract inflammation (e.g. inflammation associated with a gastrointestinal disorder, gastrointestinal tract infection, or another disorder).

The peptides and agonists of the invention can also be used to treat or prevent insulin-related disorders, for example: II diabetes mellitus, hyperglycemia, obesity, disorders associated with disturbances in glucose or electrolyte transport and insulin secretion in cells, or endocrine disorders. They can be also used in insulin resistance treatment and post-surgical and non-post surgery decrease in insulin responsiveness.

The peptides and agonists of the invention can be used to prevent and/or treat pulmonary and respiratory related disorders, including, inhalation, ventilation and mucus secretion disorders, pulmonary hypertension, chronic obstruction of vessels and airways, and irreversible obstructions of vessels and bronchi. One may administer an agent of the invention for treating bronchospasm, for inducing bronchodilation, for treating chronic obstructive pulmonary disease (including chronic bronchitis with normal airflow), for treating asthma (including bronchial asthma, intrinsic asthma, extrinsic asthma, chronic or inveterate asthma (e.g. late asthma and airways hyper-responsiveness), dust-induced asthma, allergen-induced asthma, viral-induced asthma, cold-induced asthma, pollution-induced asthma and exercise-induced asthma) and for treating rhinitis (including acute-, allergic, hatrophic rhinitis or chronic rhinitis (such as rhinitis caseosa, hypertrophic rhinitis, rhinitis purulenta, rhinitis sicca), rhinitis medicamentosa, membranous rhinitis (including croupous, fibrinous and pseudomembranous rhinitis), scrofulous rhinitis, perennial allergic rhinitis, seasonal rhinitis (including rhinitis nervosa (hay fever) and vasomotor rhinitis). The peptides of the invention may also be useful in the treatment of dry eye disease and chronic sinusitis. The peptides of the invention may also be used to prevent and/or treat disorders characterized by acute pulmonary vasoconstriction such as may result from pneumonia, traumatic injury, aspiration or inhalation injury, fat embolism in the lung, acidosis inflammation of the lung, adult respiratory distress syndrome, acute pulmonary edema, acute mountain sickness, post-cardiac surgery, acute pulmonary hypertension, persistent pulmonary hypertension of the newborn, perinatal aspiration syndrome, hyaline membrane disease, acute pulmonary thromboembolism, herapin-protamine reactions, sepsis, status asthmaticus or hypoxia (including iatrogenic hypoxia) and other forms of reversible pulmonary vasoconstriction. Such pulmonary disorders also are also characterized by inflammation of the lung including those associated with the migration into the lung of nonresident cell types including the various leucocyte subclasses. Also included in the respiratory disorders contemplated are: bullous disease, cough, chronic cough associated with inflammation or iatrogenic induced, airway constriction, pigeon fancier's disease, eosinophilic bronchitis, asthmatic bronchitis, chronic bronchitis with airway obstruction (chronic obstructive bronchitis), eosinophilic lung disease, emphysema, farmer's lung, allergic eye diseases (including allergic conjunctivitis, vernal conjunctivitis, vernal keratoconjunctivitis, and giant papillary conjunctivitis), idiopathic pulmonary fibrosis, cystic fibrosis, diffuse pan bronchiolitis and other diseases which are characterized by inflammation of the lung and/or excess mucosal secretion. Other physiological events which are contemplated to be prevented, treated or controlled include platelet activation in the lung, chronic inflammatory diseases of the lung which result in interstitial fibrosis, such as interstitial lung diseases (ILD) (e.g., idiopathic pulmonary fibrosis, or ILD associated with rheumatoid arthritis, or other autoimmune conditions), chronic obstructive pulmonary disease (COPD)(such as irreversible COPD), chronic sinusitis, fibroid lung, hypersensitivity lung diseases, hypersensitivity pneumonitis, idiopathic interstitial pneumonia, nasal congestion, nasal polyposis, and otitis media.

The peptides and agonists of the invention can be used alone or in combitherapy to prevent or treat: retinopathy, nephropathy, diabetic angiopathy, and edema formation The peptides and agonists of the invention can be used alone or in combitherapy to prevent or treat neurological disorders, for example, headache, migraines, anxiety, stress, cognitive disorders, cerebral ischemia, brain trauma, movement disorders, aggression, psychosis, seizures, panic attacks, hysteria, sleep disorders, depression, schizoaffective disorders, sleep apnea, attention deficit syndromes, memory loss, dementia, memory and learning disorders as discussed in Moncada and Higgs 1995 FASEB J. 9:1319-1330; Severina 1998 Biochemistry 63:794; Lee et al. 2000 PNAS 97: 10763-10768; Hobbs 1997 TIPS 18:484-491; Murad 1994 Adv. Pharmacol. 26:1-335; and Denninger et al. 1999 Biochim. Biophys. Acta 1411:334-350 and narcolepsy. They may also be used as a sedative.

The peptides and detectably peptides and agonists of the invention can be used as markers to identify, detect, stage, or diagnosis diseases and conditions of small intestine, including, without limitation: Crohn's disease, colitis, inflammatory bowel disease, tumors, benign tumors, such as benign stromal tumors, adenoma, angioma, adenomatous (pedunculated and sessile) polyps, malignant, carcinoid tumors, endocrine cell tumors, lymphoma, adenocarcinoma, foregut, midgut, and hindgut carcinoma, gastroinstestinal stromal tumor (GIST), such as leiomyorna, cellular leiomyoma, leiomyoblastoma, and leiomyosarcoma, gastrointestinal autonomic nerve tumor, malabsorption syndromes, celiac diseases, diverticulosis, Meckel's diverticulum, colonic diverticula, megacolon, Hirschsprung's disease, irritable bowel syndrome, mesenteric ischemia, ischemic colitis, colorectal cancer, colonic polyposis, polyp syndrome, intestinal adenocarcinoma, Liddle syndrome, Brody myopathy, infantile convulsions, and choreoathetosis The peptides and agonists of the invention can be conjugated to another molecule (e.g., a diagnostic or therapeutic molecule) to target cells bearing the GC-C receptor, e.g., cystic fibrosis lesions and specific cells lining the intestinal tract. Thus, they can be used to target radioactive moieties or therapeutic moieties to the intestine to aid in imaging and diagnosing or treating colorectal/metastasized or local colorectal cancer and to deliver normal copies of the p53 tumor suppressor gene to the intestinal tract. The peptides and agonists of the invention can also be used to increase the number of GC-C molecules on the surface of a cell.

In some embodiments the cell is a metastasized colorectal cancer cell. In one embodiment the peptide or agonist of the invention is therapeutically conjugated to a second agent. In certain embodiments, the second agent can be radioactive or radiostable. In certain embodiments the second agent can be selected from the group consisting of a compound that causes cell death, a compound that inhibits cell division, a compound that induces cell differentiation, a chemotherapeutic, a toxin and a radiosensitizing agent. In certain embodiments the second agent can be selected from the group consisting of: methotrexate, doxorubicin, daunorubicin, cytosinarabinoside, etoposide, 5-4 fluorouracil, melphalan, chlorambucil, cis-platin, vindesine, mitomycin, bleomycin, purothionin, macromomycin, 1,4-benzoquinone derivatives, trenimon, ricin, ricin A chain, *Pseudomonas* exotoxin, diphtheria toxin, *Clostridium perfringens* phospholipase C, bovine pancreatic ribonuclease, pokeweed antiviral protein, abrin, abrin A chain, cobra venom factor, gelonin, saporin, modeccin, viscumin, volkensin, nitroimidazole, metronidazole and misonidazole.

The peptides and agonists of the invention can be used alone or in combination therapy to prevent and/or treat inner ear disorders, e.g., to prevent and/or treat Meniere's disease (including symptoms thereof such as vertigo, hearing loss, tinnitus, sensation of fullness in the ear), Mal de debarquement syndrome, otitis externa, otitis media, otorrhea, acute mastoiditis, otosclerosis, otic pain, otic bleeding, otic inflammation, Lermoyez's syndrome, vestibular neuronitis, benign paroxysmal positional vertigo (BPPV), herpes zoster oticus, Ramsay Hunt's syndrome, neuronitis (including viral neuronitis), ganglionitis, geniculate herpes, labyrinthitis, purulent labyrinthitis, perilymph fistulas, presbycusis, ototoxicity (including drug-induced ototoxicity), neuromias (including acoustic neuromas), aerotitis media, infectious myringitis, bullous myringitis, squamous cell carcinoma, basal cell carcinoma, pre-cancerous otic conditions, nonchromaffin paragangliomas, chemodectomas, glomus jugulare tumors, glomus tympanicum tumors, perichondritis, aural eczematoid dermatitis, malignant external otitis, subperichondrial hematoma, ceruminomas, impacted cerumen, sebaceous cysts, osteomas, keloids, otalgia, tinnitus, tympanic membrane infection, tympanitis, otic furuncles, petrositis, conductive and sensorineural hearing loss, epidural abscess, lateral sinus thrombosis, subdural empyema, otitic hydrocephalus, Dandy's syndrome, bullous myringitis, diffuse external otitis, foreign bodies, keratosis obturans, otic neoplasm, otomycosis, trauma, acute barotitis media, acute eustachian tube obstruction, postsurgical otalgia, cholesteatoma, infections related to an otic surgical procedure, and complications associated with any of said disorders. The peptides and agonists of the invention can be used alone or in combination therapy to maintain fluid homeostasis in the inner ear.

The peptides and agonists of the invention can be used alone or in combination therapy to prevent and/or treat disorders associated with fluid and sodium retention, e.g., diseases of the electrolyte-water/electrolyte transport system within the kidney, gut and urogenital system, congestive heart failure, hypertension, hypotension, salt dependent forms of high blood pressure, hepatic edema, and liver cirrhosis. In addition they can be used to facilitate diuresis or control intestinal fluid. The peptides and agonists of the invention can also be used to treat disorders where there is abnormal proliferation of epithelial cells within the kidney (e.g. as in the case of renal cancer).

The peptides and agonists of the invention can be used alone or in combination therapy to prevent and/or treat kidney disease. "Kidney disease" includes renal failure (including acute renal failure), renal insufficiency, nephrotic edema, glomerulonephritis, pyelonephritis, kidney failure, chronic renal failure, nephritis, nephrosis, azotemia, uremia, immune renal disease, acute nephritic syndrome, rapidly progressive nephritic syndrome, nephrotic syndrome, Berger's Disease, chronic nephritic/proteinuric syndrome, tubulointerstital disease, nephrotoxic disorders, renal infarction, atheroembolic renal disease, renal cortical necrosis, malignant nephroangiosclerosis, renal vein thrombosis, renal tubular acidosis, renal glucosuria, nephrogenic diabetes insipidus, Bartter's Syndrome, Liddle's Syndrome, polycystic kidney disease, medullary cystic disease, medullary sponge kidney, hereditary nephritis, and nail-patella syndrome, along with any disease or disorder that relates to the renal system and related disorders, as well as symptoms indicative of, or related to, renal or kidney disease and related disorders.

The peptides and agonists of the invention can be used alone or in combination therapy to prevent or treat polycystic kidney disease. Polycystic kidney disease" "PKD" (also called "polycystic renal disease") refers to a group of disorders characterized by a large number of cysts distributed throughout dramatically enlarged kidneys. The resultant cyst development leads to impairment of kidney function and can eventually cause kidney failure. "PKD" specifically includes autosomal dominant polycystic kidney disease (ADPKD) and recessive autosomal recessive polycystic kidney disease (ARPKD), in all stages of development, regardless of the underlying cause.

The peptides and agonists of the invention can be used alone or in combination therapy to prevent and/or treat disorders associated with bicarbonate secretion, e.g., Cystic Fibrosis.

The peptides and agonists of the invention can be used alone or in combination therapy to prevent and/or treat disorders associated with bile secretion. In addition, they can be used to facilitate or control chloride and bile fluid secretion in the gall bladder.

The peptides and agonists of the invention can be used alone or in combination therapy to prevent and/or treat disorders associated with liver cell regeneration. This may include administration of the peptides and agonists to liver transplant recipients and to patients with drug or alcohol induced-liver damage. Furthermore, the peptides and agonists may be useful to treat liver damage as in the case of viral mediated hepatitis. The peptides and agonists of the invention may be used alone or in combination to prevent and/or treat liver abscess, liver cancer (either primary or metastatic), cirrhosis (such as cirrhosis caused by the alcohol consumption or primary biliary cirrhosis), amebic liver abscess, autoimmune hepatitis, biliary atresia, coccidioidomycosis disseminated, δ agent (hepatitis δ), hemochromatosis, hepatitis a, hepatitis b, hepatitis c, or any other acute, subacute, fulminant or chronic hepatitis of viral, metabolic or toxic etiology, hepatocellular carcinoma, pyogenic liver abscess, Reye's syndrome, sclerosing cholangitis, Wilson's disease, drug induced hepatotoxicity, or fulminant or acute liver failure. The peptides and agonists may be used in stimulating hepatic regeneration after surgical hepatectomy.

The peptides and agonists of the invention can be used alone or in combination therapy to prevent and/or treat myocardial infraction, diastolic dysfunction, angina pectoris, stable, unstable and variant (Prinzmetal) angina, atherosclerosis, thrombosis, endothelial dysfunction, cardiac edema, stroke, conditions of reduced blood vessel patency, e.g., post-percutaneous transluminal coronary angioplasty (post-PTCA) and peripheral vascular disease.

The peptides and agonists of the invention can be used alone or in combination therapy to prevent and/or treat glaucoma.

The peptides and agonists of the invention can be used alone or in combination therapy to prevent and/or treat immunodeficiency The peptides and agonists of the invention can be used alone or in combination therapy to prevent and/or treat bladder outlet obstruction and incontinence.

The peptides and agonists of the invention can be used alone or in combination therapy to prevent and/or treat male (e.g. erectile dysfunction) or female sexual dysfunction, premature labor, and dysmenorrhoea. In certain embodiments they can be used in combination with a phosphodiesterase inhibitor.

The peptides and agonists of the invention can be used alone or in combination therapy to prevent and/or treat osteopenia disorders (bone loss disorders). "Bone loss disorders" include conditions and diseases wherein the inhibition of bone loss and/or the promotion of bone formation is desirable. Among such conditions and diseases are osteoporosis, osteomyelitis, Paget's disease (osteitis deformans), periodontitis, hypercalcemia, osteonecrosis, osteosarcoma, osteolyic metastases, familial expansile osteolysis, prosthetic loosening, periprostetic osteolysis, bone loss attendant rheumatoid arthritis, and cleiodocranial dysplasia (CCD). Osteoporosis includes primary osteoporosis, endocrine osteoporosis (hyperthyroidism, hyperparathyroidism, Cushing's syndrome, and acromegaly), hereditary and congenital forms of osteoporosis (osteogenesis imperfecta, homocystinuria, Menkes' syndrome, and Rile-Day syndrome) and osteoporosis due to immobilization of extremitiesosteomyelitis, or an infectious lesion in bone leading to bone loss. The peptides and agonists can be used alone or in combination therapy to stimulating bone regeneration. The bone regeneration may be following reconstruction of bone defects in cranio-maxillofacial surgery, or following an implant into bone, for example a dental implant, bone supporting implant, or prosthesis. The bone regeneration may also be following a bone fracture.

The peptides and agonists of the invention can be used as immunogens to treat and/or prevent one or more disease symptoms associated with traveler's diarrhea. The methods described in US20040146534, U.S. Pat. No. 4,220,584, U.S. Pat. No. 4,285,391, U.S. Pat. No. 5,182,109, U.S. Pat. No. 4,603,049, U.S. Pat. No. 4,545,931, U.S. Pat. No. 4,886,663, and WO08402700 can be similarly used to create immunogens comprising the peptides of the invention.

SEQUENCE LISTING (8634 sequences)

SEQ ID NO: 1 - protein, 16 aa, Artificial Sequence
  Synthetically generated peptide
  VARIANT 1: Xaa = Ser, Asn, Tyr, Ala, Gln, Pro, Lys, Gly, or Thr, or is missing
  VARIANT 2: Xaa =  His, Asp, Glu, Ala, Ser, Asn, Gly, or is missing
  VARIANT 3: Xaa = Thr, Asp, Ser, Glu, Pro, Val or Leu
  VARIANT 5: Xaa = Asp, Ile or Glu
  VARIANT 6: Xaa = Ile, Trp or Leu
  VARIANT (7)...(0): Xaa = Cys, Ser, or Tyr
  VARIANT (8)...(0): Xaa = Ala, Val, Thr, Ile, Met or is missing
  VARIANT (9)...(0): Xaa = any amino acid; or Phe, Tyr, Asn, Trp; or an amino acid other than Phe, Trp, or Tyr; or non-aromatic amino acid ; or is missing
  VARIANT (10)...(0): Xaa = Ala, Val, Met, Thr or Ile
  VARIANT (11)...(0): Xaa = Ala or Val
  VARIANT (13)...(0): Xaa = Ala or Thr
  VARIANT (14)...(0): Xaa = Gly, Ala or Ser
  VARIANT (15)...(0): Xaa = Cys, Tyr or is missing
  VARIANT (16)...(0): Xaa = Trp, Tyr or Phe ; or Lys or Arg ; or is missing ; or His,  Leu or Ser
XXXCXXXXXXXCXXXX

SEQ ID NO: 2 - protein, 16 aa, Artificial Sequence
  Synthetically generated peptide
  VARIANT 2: Xaa = Asp or Glu
  VARIANT 3: Xaa = Asp or Glu
  VARIANT 4: Xaa = Cys or Mpt (mercaptoproline) or Pen (penicillamine) or Dpr (diaminopropionic acid) or Asp or Glu
  VARIANT 7: Xaa = Cys or Mpt (mercaptoproline) or Pen (penicillamine) or Dpr (diaminopropionic acid) or Asp or Glu
  VARIANT 10: Xaa = Val or Pro
  VARIANT (11)...(0): Xaa = Ala or Aib (alpha-aminoisobutyric acid
  VARIANT (12)...(0): Xaa = Cys or Mpt (mercaptoproline) or Pen (penicillamine) or Dpr (diaminopropionic acid) or Asp or Glu
  VARIANT (14)...(0): Xaa =  Gly or Ala
  VARIANT (15)...(0): Xaa = Cys or Mpt (mercaptoproline) or Pen (penicillamine) or Dpr (diaminopropionic acid) or Asp or Glu
NXXXELXVNXXXTXXL

SEQ ID NO: 3 - protein, 16 aa, Homo sapiens
KPGTCEICAYAACTGC

SEQ ID NO: 4 - protein, 15 aa, Homo sapiens
PGTCEICAYAACTGC

SEQ ID NO: 5 - protein, 15 aa, Artificial Sequence
  Synthetically generated peptide
PGTCEICASAACTGC

SEQ ID NO: 6 - protein, 15 aa, Artificial Sequence
  Synthetically generated peptide
PGTCEICATAACTGC

SEQ ID NO: 7 - protein, 15 aa, Artificial Sequence
  Synthetically generated peptide
PGTCEICANAACTGC

SEQ ID NO: 8 - protein, 15 aa, Artificial Sequence
  Synthetically generated peptide
PGTCEICAQAACTGC

SEQ ID NO: 9 - protein, 15 aa, Artificial Sequence
  Synthetically generated peptide
PGTCEICARAACTGC

SEQ ID NO: 10 - protein, 15 aa, Artificial Sequence
  Synthetically generated peptide
PGTCEICAEAACTGC

SEQ ID NO: 11 - protein, 15 aa, Artificial Sequence
  Synthetically generated peptide
PGTCEICADAACTGC

SEQ ID NO: 12 - protein, 15 aa, Artificial Sequence
  Synthetically generated peptide
PGTCEICAGAACTGC

SEQ ID NO: 13 - protein, 15 aa, Artificial Sequence
  Synthetically generated peptide
PGTCEICAAAACTGC

SEQ ID NO: 14 - protein, 15 aa, Artificial Sequence
  Synthetically generated peptide
PGTCEICAMAACTGC

SEQ ID NO: 15 - protein, 15 aa, Artificial Sequence
  Synthetically generated peptide
PGTCEICAIAACTGC

SEQ ID NO: 16 - protein, 13 aa, Artificial Sequence
  Synthetically generated peptide
PGTCEICAACTGC

SEQ ID NO: 17 - protein, 15 aa, Artificial Sequence
  Synthetically generated peptide
PGTCEICAVAACTGC

SEQ ID NO: 18 - protein, 15 aa, Artificial Sequence
  Synthetically generated peptide
PGTCEICAHAACTGC

SEQ ID NO: 19 - protein, 16 aa, Homo Sapiens
PGTCGEICAYAACTGC

SEQ ID NO: 20 - protein, 16 aa, Artificial Sequence
  Synthetically generated peptide
PGTCEGICAYAACTGC

SEQ ID NO: 21 - protein, 16 aa, Artificial Sequence
  Synthetically generated peptide
PGTCEIGCAYAACTGC

SEQ ID NO: 22 - protein, 16 aa, Artificial Sequence
  Synthetically generated peptide
PGTCEICGAYAACTGC

SEQ ID NO: 23 - protein, 16 aa, Artificial Sequence
  Synthetically generated peptide
PGTCEICAGYAACTGC

SEQ ID NO: 24 - protein, 16 aa, Artificial Sequence
  Synthetically generated peptide
PGTCEICAYGAACTGC

SEQ ID NO: 25 - protein, 16 aa, Artificial Sequence
  Synthetically generated peptide
PGTCEICAYAGACTGC

SEQ ID NO: 26 - protein, 16 aa, Artificial Sequence
  Synthetically generated peptide
PGTCEICAYAAGCTGC

SEQ ID NO: 27 - protein, 16 aa, Artificial Sequence
  Synthetically generated peptide
PGTCEICAYAACGTGC

SEQ ID NO: 28 - protein, 16 aa, Artificial Sequence
  Synthetically generated peptide
PGTCEICAYAACTGGC

SEQ ID NO: 29 - protein, 16 aa, Artificial Sequence
  Synthetically generated peptide
PGTCAEICAYAACTGC

SEQ ID NO: 30 - protein, 16 aa, Artificial Sequence
  Synthetically generated peptide
PGTCEAICAYAACTGC

SEQ ID NO: 31 - protein, 16 aa, Artificial Sequence
  Synthetically generated peptide
PGTCEIACAYAACTGC

SEQ ID NO: 32 - protein, 16 aa, Artificial Sequence
  Synthetically generated peptide
PGTCEICAAYAACTGC

SEQ ID NO: 33 - protein, 16 aa, Artificial Sequence
  Synthetically generated peptide
PGTCEICAYAAACTGC

SEQ ID NO: 34 - protein, 16 aa, Artificial Sequence
  Synthetically generated peptide
PGTCEICAYAACATGC

SEQ ID NO: 35 - protein, 16 aa, Artificial Sequence
  Synthetically generated peptide
PGTCEICAYAACTAGC

SEQ ID NO: 36 - protein, 16 aa, Artificial Sequence
  Synthetically generated peptide
PGTCEICAYAACTGAC

SEQ ID NO: 37 - protein, 17 aa, Artificial Sequence
  Synthetically generated peptide
PGTCAEICAAYAACTGC

SEQ ID NO: 38 - protein, 17 aa, Artificial Sequence
  Synthetically generated peptide
PGTCEAICAAYAACTGC

SEQ ID NO: 39 - protein, 17 aa, Artificial Sequence
  Synthetically generated peptide
PGTCEIACAAYAACTGC

SEQ ID NO: 40 - protein, 15 aa, Didelphis virginiana
SHTCEICAFAACAGC

SEQ ID NO: 41 - protein, 15 aa, Sus scrofa
PSTCEICAYAACAGC

SEQ ID NO: 42 - protein, 15 aa, Rattus norvegicus
PNTCEICAYAACTGC

SEQ ID NO: 43 - protein, 16 aa, Anguilla anguilla
PDPCEICANAACTGCL

SEQ ID NO: 44 - protein, 16 aa, Homo sapiens
NDDCELCVNVACTGCL

SEQ ID NO: 45 - protein, 15 aa, Didelphis virginiana
QEECELCINMACTGY

SEQ ID NO: 46 - protein, 16 aa, Sus scrofa
GDDCELCVNVACTGCS

SEQ ID NO: 47 - protein, 15 aa, Cavia porcellus
NDECELCVNIACTGC

SEQ ID NO: 48 - protein, 15 aa, Ratus norvegicus
TDECELCINVACTGC

SEQ ID NO: 49 - protein, 15 aa, Didelphis virginiana
QEDCELCINVACTGC

SEQ ID NO: 50 - protein, 38 aa, Homo sapiens
MPSTQYIRRPASSYASCIWCTTACASCHGRTTKPSLAT

SEQ ID NO: 51 - protein, 38 aa, Artificial Sequence
  Synthetically generated peptide
MPSTQYIRRPASSYASCIWCATACASCHGRTTKPSLAT

SEQ ID NO: 52 - protein, 38 aa, Artificial Sequence
  Synthetically generated peptide
MPSTQYIRRPTSSYASCIWCATACASCHGRTTKPSLAT

SEQ ID NO: 53 - protein, 38 aa, Artificial Sequence
  Synthetically generated peptide
MPSTQYIRRPTSSYASCIWCATVCASCHGRTTKPSLAT

SEQ ID NO: 54 - protein, 38 aa, Artificial Sequence
  Synthetically generated peptide
MPSTQYIRRPASSYASCIWYATACASCHGRTTEPSLAT

SEQ ID NO: 55 - protein, 15 aa, Didelphis virginiana
QEECELSINMACTGY

SEQ ID NO: 56 - protein, 15 aa, Anguilla japonica
YDECEICMFAACTGC

SEQ ID NO: 57 - protein, 13 aa, Danio rerio
VCEICAFAACTGC

SEQ ID NO: 58 - protein, 16 aa, Anguilla japonica
ADLCEICAFAACTGCL

SEQ ID NO: 59 - protein, 16 aa, Artificial Sequence
  Synthetically generated peptide
PGTCEICAYAACTGCL

SEQ ID NO: 60 - protein, 18 aa, Artificial Sequence
  Synthetically generated peptide
PGTCEICAYAACTGCLKK

SEQ ID NO: 61 - protein, 21 aa, Artificial Sequence
  Synthetically generated peptide
PNTCEICAYAACTGCKKKKKK

SEQ ID NO: 62 - protein, 16 aa, Artificial Sequence
  Synthetically generated peptide
PNTCEICAYAACTGCD

SEQ ID NO: 63 - protein, 17 aa, Artificial Sequence
  Synthetically generated peptide
PNTCEICAYAACTGCDK

SEQ ID NO: 64 - protein, 16 aa, Artificial Sequence
  Synthetically generated peptide
YPNTCEICAYAACTGC

SEQ ID NO: 65 - protein, 15 aa, Artificial Sequence
  Synthetically generated peptide
KNTCEICAYAACTGC

SEQ ID NO: 66 - protein, 16 aa, Artificial Sequence
  Synthetically generated peptide
KPNTCEICAYAACTGC

SEQ ID NO: 67 - protein, 17 aa, Artificial Sequence
  Synthetically generated peptide
EDPGTCEICAYAACTGC

SEQ ID NO: 68 - protein, 94 aa, Artificial Sequence
  Synthetically generated peptide
VTVQDGNFSFSLESVKKLKDLQEPQEPRVGKLRNFAPIPGEPVVPILCSNPNFPEELKPLCKEPNAQEILQRLEEIAEDPGTCEICAYAACTGC

SEQ ID NO: 69 - protein, 16 aa, Artificial Sequence
  Synthetically generated peptide
DPGTCEICAYAACTGC

SEQ ID NO: 70 - protein, 115 aa, Artificial Sequence
  Synthetically generated peptide
MNAFLLSALCLLGAWAALAGGVTVQDGNFSFSLESVKKLKDLQEPQEPRVGKLRNFAPIPGEPVVPILCSNPNFPEELKPLCKEPNAQEILQRLEEIAEDPGTCEICAYAACTGC

SEQ ID NO: 71 - protein, 102 aa, Artificial Sequence
  Synthetically generated peptide
MNAFLLFALCLLGAWAALAGGVTVQDGNFSFSLEPRVGKLRNFAPIPGEPVVPILCSNPNFPEELKPLCKEPNAQEILQRLEEIAEDPGTCEICAYAACTGC

SEQ ID NO: 72 - protein, 108 aa, Artificial Sequence
  Synthetically generated peptide
TGSMNAFLLFALCLLGAWAALAGGVTVQDGNFSFSLEPRVGKLRNFAPIPGEPVVPILCSNPNFPEELKPLCKEPNAQEILQRLEEIAEDPGTCEICAYAACTGCLEG

SEQ ID NO: 73 - protein, 16 aa, Artificial Sequence
  Synthetically generated peptide
NDECELCVNVACTGCL

SEQ ID NO: 74 - protein, 14 aa, Artificial Sequence
  Synthetically generated peptide
ECELCVNVACTGCL

SEQ ID NO: 75 - protein, 14 aa, Artificial Sequence
  Synthetically generated peptide
EDCELCINVACTGC

SEQ ID NO: 76 - protein, 14 aa, Artificial Sequence
  Synthetically generated peptide
NDDCELCVACTGCL

SEQ ID NO: 77 - protein, 24 aa, Artificial Sequence
  Synthetically generated peptide
FKTLRTIANDDCELCVNVACTGCL

SEQ ID NO: 78 - protein, 23 aa, Artificial Sequence
  Synthetically generated peptide
FKTLRTIANDDCLCVNVACTGCL

SEQ ID NO: 79 - protein, 15 aa, Artificial Sequence
  Synthetically generated peptide
DDCELCVNVACTGCL

SEQ ID NO: 80 - protein, 14 aa, Artificial Sequence
  Synthetically generated peptide
DCELCVNVACTGCL

SEQ ID NO: 81 - protein, 13 aa, Artificial Sequence
  Synthetically generated peptide
CELCVNVACTGCL

SEQ ID NO: 82 - protein, 16 aa, Artificial Sequence
  Synthetically generated peptide
KDDCELCVNVACTGCL

SEQ ID NO: 83 - protein, 15 aa, Artificial Sequence
  Synthetically generated peptide
PNTCEICANPACTGC

SEQ ID NO: 84 - protein, 15 aa, Artificial Sequence
  Synthetically generated peptide
  VARIANT 9: Xaa = any amino acid other than Phe; or Phe and Trp; or Phe, Trp, Ile, Leu and Val; or Phe, Trp, Ile, Leu, Val and His; or any non-aromatic amino acid ; or Xaa is missing
  VARIANT (1)...(15): Xaa = Any Amino Acid
  VARIANT (1)...(15): Xaa = Any Amino Acid
PGTCEICAXAACTGC

SEQ ID NO: 85 - protein, 5 aa, Artificial Sequence
  Synthetically generated peptide
QHNPR

SEQ ID NO: 86 - protein, 6 aa, Artificial Sequence
  Synthetically generated peptide
VQHNPR

SEQ ID NO: 87 - protein, 7 aa, Artificial Sequence
  Synthetically generated peptide
VRQHNPR

SEQ ID NO: 88 - protein, 8 aa, Artificial Sequence
  Synthetically generated peptide
VRGQHNPR

SEQ ID NO: 89 - protein, 9 aa, Artificial Sequence
  Synthetically generated peptide
VRGPQHNPR

SEQ ID NO: 90 - protein, 10 aa, Artificial Sequence
  Synthetically generated peptide
VRGPRQHNPR

SEQ ID NO: 91 - protein, 11 aa, Artificial Sequence
  Synthetically generated peptide
VRGPRRQHNPR

SEQ ID NO: 92 - protein, 6 aa, Artificial Sequence
  Synthetically generated peptide
RQHNPR

SEQ ID NO: 93 - protein, 6 aa, Artificial Sequence
  Synthetically generated peptide
KKKKKK

SEQ ID NO: 94 - protein, 7 aa, Artificial Sequence
  Synthetically generated peptide
DKKKKKK

SEQ ID NO: 95 - protein, 75 aa, Artificial Sequence
  Synthetically generated peptide
  VARIANT 2-5, 7-10, 12-15, 17-20, 22-25, 27-30, 32-35, 37-40, 42-45,47-50, 52-55, 57-60, 62-65, 67-70, 72-75: Xaa = any amino acid
  VARIANT (1)...(75): Xaa = Any Amino Acid
  VARIANT (1)...(75): Xaa = Any Amino Acid
PXXXXGXXXXTXXXXCXXXXEXXXXIXXXXCXXXXAXXXXYXXXXAXXXXAXXXXCXXXXTXXXXGXXXXCXXXX

SEQ ID NO: 96 - protein, 15 aa, Artificial Sequence
  Synthetically generated peptide
GTCGEICAYAACTGC

SEQ ID NO: 97 - protein, 14 aa, Artificial Sequence
  Synthetically generated peptide
TCGEICAYAACTGC

SEQ ID NO: 98 - protein, 13 aa, Artificial Sequence
  Synthetically generated peptide
CGEICAYAACTGC

SEQ ID NO: 99 - protein, 12 aa, Artificial Sequence
  Synthetically generated peptide
CEICAYAACTGC

SEQ ID NO: 100 - protein, 12 aa, Artificial Sequence
  Synthetically generated peptide
CGICAYAACTGC

SEQ ID NO: 101 - protein, 12 aa, Artificial Sequence
  Synthetically generated peptide
CGECAYAACTGC

SEQ ID NO: 102 - protein, 12 aa, Artificial Sequence
  Synthetically generated peptide
CGEICYAACTGC

SEQ ID NO: 103 - protein, 12 aa, Artificial Sequence
  Synthetically generated peptide
CGEICAAACTGC

SEQ ID NO: 104 - protein, 12 aa, Artificial Sequence
  Synthetically generated peptide
CGEICAYACTGC

SEQ ID NO: 105 - protein, 12 aa, Artificial Sequence
  Synthetically generated peptide
CGEICAYACTGC

SEQ ID NO: 106 - protein, 12 aa, Artificial Sequence
  Synthetically generated peptide
CGEICAYAACGC

SEQ ID NO: 107 - protein, 12 aa, Artificial Sequence
  Synthetically generated peptide
CGEICAYAACTC

SEQ ID NO: 108 - protein, 13 aa, Artificial Sequence
  Synthetically generated peptide
TCEICAYAACTGC

SEQ ID NO: 109 - protein, 12 aa, Artificial Sequence
  Synthetically generated peptide
TCICAYAACTGC

SEQ ID NO: 110 - protein, 12 aa, Artificial Sequence
  Synthetically generated peptide
TCECAYAACTGC

SEQ ID NO: 111 - protein, 12 aa, Artificial Sequence
  Synthetically generated peptide
TCEICYAACTGC

SEQ ID NO: 112 - protein, 12 aa, Artificial Sequence
  Synthetically generated peptide
TCEICAAACTGC

SEQ ID NO: 113 - protein, 12 aa, Artificial Sequence
  Synthetically generated peptide
TCEICAYACTGC

SEQ ID NO: 114 - protein, 12 aa, Artificial Sequence
  Synthetically generated peptide
TCEICAYACTGC

SEQ ID NO: 115 - protein, 12 aa, Artificial Sequence
  Synthetically generated peptide
TCEICAYAACGC

SEQ ID NO: 116 - protein, 12 aa, Artificial Sequence
  Synthetically generated peptide
TCEICAYAACTC

SEQ ID NO: 117 - protein, 13 aa, Artificial Sequence
  Synthetically generated peptide
TCGICAYAACTGC

SEQ ID NO: 118 - protein, 12 aa, Artificial Sequence
  Synthetically generated peptide
TCGCAYAACTGC

SEQ ID NO: 119 - protein, 12 aa, Artificial Sequence
  Synthetically generated peptide
TCGICYAACTGC

SEQ ID NO: 120 - protein, 12 aa, Artificial Sequence
  Synthetically generated peptide
TCGICAAACTGC

SEQ ID NO: 121 - protein, 12 aa, Artificial Sequence
  Synthetically generated peptide
TCGICAYACTGC

SEQ ID NO: 122 - protein, 12 aa, Artificial Sequence
  Synthetically generated peptide
TCGICAYACTGC

SEQ ID NO: 123 - protein, 12 aa, Artificial Sequence
  Synthetically generated peptide
TCGICAYAACGC

SEQ ID NO: 124 - protein, 12 aa, Artificial Sequence
  Synthetically generated peptide
TCGICAYAACTC

SEQ ID NO: 125 - protein, 13 aa, Artificial Sequence
  Synthetically generated peptide
TCGECAYAACTGC

SEQ ID NO: 126 - protein, 12 aa, Artificial Sequence
  Synthetically generated peptide
TCGECYAACTGC

SEQ ID NO: 127 - protein, 12 aa, Artificial Sequence
  Synthetically generated peptide
TCGECAAACTGC

SEQ ID NO: 128 - protein, 12 aa, Artificial Sequence
  Synthetically generated peptide
TCGECAYACTGC

SEQ ID NO: 129 - protein, 12 aa, Artificial Sequence
  Synthetically generated peptide
TCGECAYACTGC

SEQ ID NO: 130 - protein, 12 aa, Artificial Sequence
  Synthetically generated peptide
TCGECAYAACGC

SEQ ID NO: 131 - protein, 12 aa, Artificial Sequence
  Synthetically generated peptide
TCGECAYAACTC

SEQ ID NO: 132 - protein, 13 aa, Artificial Sequence
  Synthetically generated peptide
TCGEICYAACTGC

SEQ ID NO: 133 - protein, 12 aa, Artificial Sequence
  Synthetically generated peptide
TCGEICAACTGC

SEQ ID NO: 134 - protein, 12 aa, Artificial Sequence
  Synthetically generated peptide
TCGEICYACTGC

SEQ ID NO: 135 - protein, 12 aa, Artificial Sequence
  Synthetically generated peptide
TCGEICYACTGC

SEQ ID NO: 136 - protein, 12 aa, Artificial Sequence
  Synthetically generated peptide
TCGEICYAACGC

SEQ ID NO: 137 - protein, 12 aa, Artificial Sequence
  Synthetically generated peptide
TCGEICYAACTC

SEQ ID NO: 138 - protein, 13 aa, Artificial Sequence
  Synthetically generated peptide
TCGEICAAACTGC

SEQ ID NO: 139 - protein, 12 aa, Artificial Sequence
  Synthetically generated peptide
TCGEICAACTGC

SEQ ID NO: 140 - protein, 12 aa, Artificial Sequence
  Synthetically generated peptide
TCGEICAACTGC

SEQ ID NO: 141 - protein, 12 aa, Artificial Sequence
  Synthetically generated peptide
TCGEICAAACGC

SEQ ID NO: 142 - protein, 12 aa, Artificial Sequence
  Synthetically generated peptide
TCGEICAAACTC

SEQ ID NO: 143 - protein, 13 aa, Artificial Sequence
  Synthetically generated peptide
TCGEICAYACTGC

SEQ ID NO: 144 - protein, 12 aa, Artificial Sequence
  Synthetically generated peptide
TCGEICAYCTGC

SEQ ID NO: 145 - protein, 12 aa, Artificial Sequence
  Synthetically generated peptide
TCGEICAYACGC

SEQ ID NO: 146 - protein, 12 aa, Artificial Sequence
  Synthetically generated peptide
TCGEICAYACTC

SEQ ID NO: 147 - protein, 13 aa, Artificial Sequence
  Synthetically generated peptide
TCGEICAYACTGC

SEQ ID NO: 148 - protein, 12 aa, Artificial Sequence
  Synthetically generated peptide
TCGEICAYACGC

SEQ ID NO: 149 - protein, 12 aa, Artificial Sequence
  Synthetically generated peptide
TCGEICAYACTC

SEQ ID NO: 150 - protein, 13 aa, Artificial Sequence
  Synthetically generated peptide
TCGEICAYAACGC

SEQ ID NO: 151 - protein, 12 aa, Artificial Sequence
  Synthetically generated peptide
TCGEICAYAACC

SEQ ID NO: 152 - protein, 13 aa, Artificial Sequence
  Synthetically generated peptide
TCGEICAYAACTC

SEQ ID NO: 153 - protein, 14 aa, Artificial Sequence
  Synthetically generated peptide
GCGEICAYAACTGC

SEQ ID NO: 154 - protein, 13 aa, Artificial Sequence
  Synthetically generated peptide
GCEICAYAACTGC

SEQ ID NO: 155 - protein, 12 aa, Artificial Sequence
  Synthetically generated peptide
GCICAYAACTGC

SEQ ID NO: 156 - protein, 12 aa, Artificial Sequence
  Synthetically generated peptide
GCECAYAACTGC

SEQ ID NO: 157 - protein, 12 aa, Artificial Sequence
  Synthetically generated peptide
GCEICYAACTGC

SEQ ID NO: 158 - protein, 12 aa, Artificial Sequence
  Synthetically generated peptide
GCEICAAACTGC

SEQ ID NO: 159 - protein, 12 aa, Artificial Sequence
  Synthetically generated peptide
GCEICAYACTGC

SEQ ID NO: 160 - protein, 12 aa, Artificial Sequence
  Synthetically generated peptide
GCEICAYACTGC

SEQ ID NO: 161 - protein, 12 aa, Artificial Sequence
  Synthetically generated peptide
GCEICAYAACGC

SEQ ID NO: 162 - protein, 12 aa, Artificial Sequence
  Synthetically generated peptide
GCEICAYAACTC

SEQ ID NO: 163 - protein, 13 aa, Artificial Sequence
  Synthetically generated peptide
GCGICAYAACTGC

SEQ ID NO: 164 - protein, 12 aa, Artificial Sequence
  Synthetically generated peptide
GCGCAYAACTGC

SEQ ID NO: 165 - protein, 12 aa, Artificial Sequence
  Synthetically generated peptide
GCGICYAACTGC

SEQ ID NO: 166 - protein, 12 aa, Artificial Sequence
  Synthetically generated peptide
GCGICAAACTGC

SEQ ID NO: 167 - protein, 12 aa, Artificial Sequence
  Synthetically generated peptide
GCGICAYACTGC

SEQ ID NO: 168 - protein, 12 aa, Artificial Sequence
  Synthetically generated peptide
GCGICAYACTGC

SEQ ID NO: 169 - protein, 12 aa, Artificial Sequence
  Synthetically generated peptide
GCGICAYAACGC

SEQ ID NO: 170 - protein, 12 aa, Artificial Sequence
  Synthetically generated peptide
GCGICAYAACTC

SEQ ID NO: 171 - protein, 13 aa, Artificial Sequence
  Synthetically generated peptide
GCGECAYAACTGC

SEQ ID NO: 172 - protein, 12 aa, Artificial Sequence
  Synthetically generated peptide
GCGECYAACTGC

SEQ ID NO: 173 - protein, 12 aa, Artificial Sequence
  Synthetically generated peptide
GCGECAAACTGC

SEQ ID NO: 174 - protein, 12 aa, Artificial Sequence
  Synthetically generated peptide
GCGECAYACTGC

SEQ ID NO: 175 - protein, 12 aa, Artificial Sequence
  Synthetically generated peptide
GCGECAYACTGC

SEQ ID NO: 176 - protein, 12 aa, Artificial Sequence
  Synthetically generated peptide
GCGECAYAACGC

SEQ ID NO: 177 - protein, 12 aa, Artificial Sequence
  Synthetically generated peptide
GCGECAYAACTC

SEQ ID NO: 178 - protein, 13 aa, Artificial Sequence
  Synthetically generated peptide
GCGEICYAACTGC

SEQ ID NO: 179 - protein, 12 aa, Artificial Sequence
  Synthetically generated peptide
GCGEICAACTGC

SEQ ID NO: 180 - protein, 12 aa, Artificial Sequence
  Synthetically generated peptide
GCGEICYACTGC

SEQ ID NO: 181 - protein, 12 aa, Artificial Sequence
  Synthetically generated peptide
GCGEICYACTGC

SEQ ID NO: 182 - protein, 12 aa, Artificial Sequence
  Synthetically generated peptide
GCGEICYAACGC

SEQ ID NO: 183 - protein, 12 aa, Artificial Sequence
  Synthetically generated peptide
GCGEICYAACTC

SEQ ID NO: 184 - protein, 13 aa, Artificial Sequence
  Synthetically generated peptide
GCGEICAAACTGC

SEQ ID NO: 185 - protein, 12 aa, Artificial Sequence
  Synthetically generated peptide
GCGEICAACTGC

SEQ ID NO: 186 - protein, 12 aa, Artificial Sequence
  Synthetically generated peptide
GCGEICAACTGC

SEQ ID NO: 187 - protein, 12 aa, Artificial Sequence
  Synthetically generated peptide
GCGEICAAACGC

SEQ ID NO: 188 - protein, 12 aa, Artificial Sequence
  Synthetically generated peptide
GCGEICAAACTC

SEQ ID NO: 189 - protein, 13 aa, Artificial Sequence
  Synthetically generated peptide
GCGEICAYACTGC

SEQ ID NO: 190 - protein, 12 aa, Artificial Sequence
  Synthetically generated peptide
GCGEICAYCTGC

SEQ ID NO: 191 - protein, 12 aa, Artificial Sequence
  Synthetically generated peptide
GCGEICAYACGC

SEQ ID NO: 192 - protein, 12 aa, Artificial Sequence
  Synthetically generated peptide
GCGEICAYACTC

SEQ ID NO: 193 - protein, 13 aa, Artificial Sequence
  Synthetically generated peptide
GCGEICAYACTGC

SEQ ID NO: 194 - protein, 12 aa, Artificial Sequence
  Synthetically generated peptide
GCGEICAYACGC

SEQ ID NO: 195 - protein, 12 aa, Artificial Sequence
  Synthetically generated peptide
GCGEICAYACTC

SEQ ID NO: 196 - protein, 13 aa, Artificial Sequence
  Synthetically generated peptide
GCGEICAYAACGC

SEQ ID NO: 197 - protein, 12 aa, Artificial Sequence
  Synthetically generated peptide
GCGEICAYAACC

SEQ ID NO: 198 - protein, 13 aa, Artificial Sequence
  Synthetically generated peptide
GCGEICAYAACTC

SEQ ID NO: 199 - protein, 14 aa, Artificial Sequence
  Synthetically generated peptide
GTCEICAYAACTGC

SEQ ID NO: 200 - protein, 13 aa, Artificial Sequence
  Synthetically generated peptide
GTCICAYAACTGC

SEQ ID NO: 201 - protein, 12 aa, Artificial Sequence
  Synthetically generated peptide
GTCCAYAACTGC

SEQ ID NO: 202 - protein, 12 aa, Artificial Sequence
  Synthetically generated peptide
GTCICYAACTGC

SEQ ID NO: 203 - protein, 12 aa, Artificial Sequence
  Synthetically generated peptide
GTCICAAACTGC

SEQ ID NO: 204 - protein, 12 aa, Artificial Sequence
  Synthetically generated peptide
GTCICAYACTGC

SEQ ID NO: 205 - protein, 12 aa, Artificial Sequence
  Synthetically generated peptide
GTCICAYACTGC

SEQ ID NO: 206 - protein, 12 aa, Artificial Sequence
  Synthetically generated peptide
GTCICAYAACGC

SEQ ID NO: 207 - protein, 12 aa, Artificial Sequence
  Synthetically generated peptide
GTCICAYAACTC

SEQ ID NO: 208 - protein, 13 aa, Artificial Sequence
  Synthetically generated peptide
GTCECAYAACTGC

SEQ ID NO: 209 - protein, 12 aa, Artificial Sequence
  Synthetically generated peptide
GTCECYAACTGC

SEQ ID NO: 210 - protein, 12 aa, Artificial Sequence
  Synthetically generated peptide
GTCECAAACTGC

SEQ ID NO: 211 - protein, 12 aa, Artificial Sequence
  Synthetically generated peptide
GTCECAYACTGC

SEQ ID NO: 212 - protein, 12 aa, Artificial Sequence
  Synthetically generated peptide
GTCECAYACTGC

SEQ ID NO: 213 - protein, 12 aa, Artificial Sequence
  Synthetically generated peptide
GTCECAYAACGC

SEQ ID NO: 214 - protein, 12 aa, Artificial Sequence
  Synthetically generated peptide
GTCECAYAACTC

SEQ ID NO: 215 - protein, 13 aa, Artificial Sequence
  Synthetically generated peptide
GTCEICYAACTGC

SEQ ID NO: 216 - protein, 12 aa, Artificial Sequence
  Synthetically generated peptide
GTCEICAACTGC

SEQ ID NO: 217 - protein, 12 aa, Artificial Sequence
  Synthetically generated peptide
GTCEICYACTGC

SEQ ID NO: 218 - protein, 12 aa, Artificial Sequence
  Synthetically generated peptide
GTCEICYACTGC

SEQ ID NO: 219 - protein, 12 aa, Artificial Sequence
  Synthetically generated peptide
GTCEICYAACGC

SEQ ID NO: 220 - protein, 12 aa, Artificial Sequence
  Synthetically generated peptide
GTCEICYAACTC

SEQ ID NO: 221 - protein, 13 aa, Artificial Sequence
  Synthetically generated peptide
GTCEICAAACTGC

SEQ ID NO: 222 - protein, 12 aa, Artificial Sequence
  Synthetically generated peptide
GTCEICAACTGC

SEQ ID NO: 223 - protein, 12 aa, Artificial Sequence
  Synthetically generated peptide
GTCEICAACTGC

SEQ ID NO: 224 - protein, 12 aa, Artificial Sequence
  Synthetically generated peptide
GTCEICAAACGC

SEQ ID NO: 225 - protein, 12 aa, Artificial Sequence
  Synthetically generated peptide
GTCEICAAACTC

SEQ ID NO: 226 - protein, 13 aa, Artificial Sequence
  Synthetically generated peptide
GTCEICAYACTGC

SEQ ID NO: 227 - protein, 12 aa, Artificial Sequence
  Synthetically generated peptide
GTCEICAYCTGC

SEQ ID NO: 228 - protein, 12 aa, Artificial Sequence
  Synthetically generated peptide
GTCEICAYACGC

SEQ ID NO: 229 - protein, 12 aa, Artificial Sequence
  Synthetically generated peptide
GTCEICAYACTC

SEQ ID NO: 230 - protein, 13 aa, Artificial Sequence
  Synthetically generated peptide
GTCEICAYACTGC

SEQ ID NO: 231 - protein, 12 aa, Artificial Sequence
  Synthetically generated peptide
GTCEICAYACGC

SEQ ID NO: 232 - protein, 12 aa, Artificial Sequence
  Synthetically generated peptide
GTCEICAYACTC

SEQ ID NO: 233 - protein, 13 aa, Artificial Sequence
  Synthetically generated peptide
GTCEICAYAACGC

SEQ ID NO: 234 - protein, 12 aa, Artificial Sequence
  Synthetically generated peptide
GTCEICAYAACC

SEQ ID NO: 235 - protein, 13 aa, Artificial Sequence
  Synthetically generated peptide
GTCEICAYAACTC

SEQ ID NO: 236 - protein, 14 aa, Artificial Sequence
  Synthetically generated peptide
GTCGICAYAACTGC

SEQ ID NO: 237 - protein, 13 aa, Artificial Sequence
  Synthetically generated peptide
GTCGCAYAACTGC

SEQ ID NO: 238 - protein, 12 aa, Artificial Sequence
  Synthetically generated peptide
GTCGCYAACTGC

SEQ ID NO: 239 - protein, 12 aa, Artificial Sequence
  Synthetically generated peptide
GTCGCAAACTGC

SEQ ID NO: 240 - protein, 12 aa, Artificial Sequence
  Synthetically generated peptide
GTCGCAYACTGC

SEQ ID NO: 241 - protein, 12 aa, Artificial Sequence
  Synthetically generated peptide
GTCGCAYACTGC

SEQ ID NO: 242 - protein, 12 aa, Artificial Sequence
  Synthetically generated peptide
GTCGCAYAACGC

SEQ ID NO: 243 - protein, 12 aa, Artificial Sequence
  Synthetically generated peptide
GTCGCAYAACTC

SEQ ID NO: 244 - protein, 13 aa, Artificial Sequence
  Synthetically generated peptide
GTCGICYAACTGC

SEQ ID NO: 245 - protein, 12 aa, Artificial Sequence
  Synthetically generated peptide
GTCGICAACTGC

SEQ ID NO: 246 - protein, 12 aa, Artificial Sequence
  Synthetically generated peptide
GTCGICYACTGC

SEQ ID NO: 247 - protein, 12 aa, Artificial Sequence
  Synthetically generated peptide
GTCGICYACTGC

SEQ ID NO: 248 - protein, 12 aa, Artificial Sequence
  Synthetically generated peptide
GTCGICYAACGC

SEQ ID NO: 249 - protein, 12 aa, Artificial Sequence
  Synthetically generated peptide
GTCGICYAACTC

SEQ ID NO: 250 - protein, 13 aa, Artificial Sequence
  Synthetically generated peptide
GTCGICAAACTGC

SEQ ID NO: 251 - protein, 12 aa, Artificial Sequence
  Synthetically generated peptide
GTCGICAACTGC

SEQ ID NO: 252 - protein, 12 aa, Artificial Sequence
  Synthetically generated peptide
GTCGICAACTGC

SEQ ID NO: 253 - protein, 12 aa, Artificial Sequence
  Synthetically generated peptide
GTCGICAAACGC

SEQ ID NO: 254 - protein, 12 aa, Artificial Sequence
  Synthetically generated peptide
GTCGICAAACTC

SEQ ID NO: 255 - protein, 13 aa, Artificial Sequence
  Synthetically generated peptide
GTCGICAYACTGC

SEQ ID NO: 256 - protein, 12 aa, Artificial Sequence
  Synthetically generated peptide
GTCGICAYCTGC

SEQ ID NO: 257 - protein, 12 aa, Artificial Sequence
  Synthetically generated peptide
GTCGICAYACGC

SEQ ID NO: 258 - protein, 12 aa, Artificial Sequence
  Synthetically generated peptide
GTCGICAYACTC

SEQ ID NO: 259 - protein, 13 aa, Artificial Sequence
  Synthetically generated peptide
GTCGICAYACTGC

SEQ ID NO: 260 - protein, 12 aa, Artificial Sequence
  Synthetically generated peptide
GTCGICAYACGC

SEQ ID NO: 261 - protein, 12 aa, Artificial Sequence
  Synthetically generated peptide
GTCGICAYACTC

SEQ ID NO: 262 - protein, 13 aa, Artificial Sequence
  Synthetically generated peptide
GTCGICAYAACGC

SEQ ID NO: 263 - protein, 12 aa, Artificial Sequence
  Synthetically generated peptide
GTCGICAYAACC

SEQ ID NO: 264 - protein, 13 aa, Artificial Sequence
  Synthetically generated peptide
GTCGICAYAACTC

SEQ ID NO: 265 - protein, 14 aa, Artificial Sequence
  Synthetically generated peptide
GTCGECAYAACTGC

SEQ ID NO: 266 - protein, 13 aa, Artificial Sequence
  Synthetically generated peptide
GTCGECYAACTGC

SEQ ID NO: 267 - protein, 12 aa, Artificial Sequence
  Synthetically generated peptide
GTCGECAACTGC

SEQ ID NO: 268 - protein, 12 aa, Artificial Sequence
  Synthetically generated peptide
GTCGECYACTGC

SEQ ID NO: 269 - protein, 12 aa, Artificial Sequence
  Synthetically generated peptide
GTCGECYACTGC

SEQ ID NO: 270 - protein, 12 aa, Artificial Sequence
  Synthetically generated peptide
GTCGECYAACGC

SEQ ID NO: 271 - protein, 12 aa, Artificial Sequence
  Synthetically generated peptide
GTCGECYAACTC

SEQ ID NO: 272 - protein, 13 aa, Artificial Sequence
  Synthetically generated peptide
GTCGECAAACTGC

SEQ ID NO: 273 - protein, 12 aa, Artificial Sequence
  Synthetically generated peptide
GTCGECAACTGC

SEQ ID NO: 274 - protein, 12 aa, Artificial Sequence
  Synthetically generated peptide
GTCGECAACTGC

SEQ ID NO: 275 - protein, 12 aa, Artificial Sequence
  Synthetically generated peptide
GTCGECAAACGC

SEQ ID NO: 276 - protein, 12 aa, Artificial Sequence
  Synthetically generated peptide
GTCGECAAACTC

SEQ ID NO: 277 - protein, 13 aa, Artificial Sequence
  Synthetically generated peptide
GTCGECAYACTGC

SEQ ID NO: 278 - protein, 12 aa, Artificial Sequence
  Synthetically generated peptide
GTCGECAYCTGC

SEQ ID NO: 279 - protein, 12 aa, Artificial Sequence
  Synthetically generated peptide
GTCGECAYACGC

SEQ ID NO: 280 - protein, 12 aa, Artificial Sequence
  Synthetically generated peptide
GTCGECAYACTC

SEQ ID NO: 281 - protein, 13 aa, Artificial Sequence
  Synthetically generated peptide
GTCGECAYACTGC

SEQ ID NO: 282 - protein, 12 aa, Artificial Sequence
  Synthetically generated peptide
GTCGECAYACGC

SEQ ID NO: 283 - protein, 12 aa, Artificial Sequence
  Synthetically generated peptide
GTCGECAYACTC

SEQ ID NO: 284 - protein, 13 aa, Artificial Sequence
  Synthetically generated peptide
GTCGECAYAACGC

SEQ ID NO: 285 - protein, 12 aa, Artificial Sequence
  Synthetically generated peptide
GTCGECAYAACC

SEQ ID NO: 286 - protein, 13 aa, Artificial Sequence
  Synthetically generated peptide
GTCGECAYAACTC

SEQ ID NO: 287 - protein, 14 aa, Artificial Sequence
  Synthetically generated peptide
GTCGEICYAACTGC

SEQ ID NO: 288 - protein, 13 aa, Artificial Sequence
  Synthetically generated peptide
GTCGEICAACTGC

SEQ ID NO: 289 - protein, 12 aa, Artificial Sequence
  Synthetically generated peptide
GTCGEICACTGC

SEQ ID NO: 290 - protein, 12 aa, Artificial Sequence
  Synthetically generated peptide
GTCGEICACTGC

SEQ ID NO: 291 - protein, 12 aa, Artificial Sequence
  Synthetically generated peptide
GTCGEICAACGC

SEQ ID NO: 292 - protein, 12 aa, Artificial Sequence
  Synthetically generated peptide
GTCGEICAACTC

SEQ ID NO: 293 - protein, 13 aa, Artificial Sequence
  Synthetically generated peptide
GTCGEICYACTGC

SEQ ID NO: 294 - protein, 12 aa, Artificial Sequence
  Synthetically generated peptide
GTCGEICYCTGC

SEQ ID NO: 295 - protein, 12 aa, Artificial Sequence
  Synthetically generated peptide
GTCGEICYACGC

SEQ ID NO: 296 - protein, 12 aa, Artificial Sequence
  Synthetically generated peptide
GTCGEICYACTC

SEQ ID NO: 297 - protein, 13 aa, Artificial Sequence
  Synthetically generated peptide
GTCGEICYACTGC

SEQ ID NO: 298 - protein, 12 aa, Artificial Sequence
  Synthetically generated peptide
GTCGEICYACGC

SEQ ID NO: 299 - protein, 12 aa, Artificial Sequence
  Synthetically generated peptide
GTCGEICYACTC

SEQ ID NO: 300 - protein, 13 aa, Artificial Sequence
  Synthetically generated peptide
GTCGEICYAACGC

SEQ ID NO: 301 - protein, 12 aa, Artificial Sequence
  Synthetically generated peptide
GTCGEICYAACC

SEQ ID NO: 302 - protein, 13 aa, Artificial Sequence
  Synthetically generated peptide
GTCGEICYAACTC

SEQ ID NO: 303 - protein, 14 aa, Artificial Sequence
  Synthetically generated peptide
GTCGEICAAACTGC

SEQ ID NO: 304 - protein, 13 aa, Artificial Sequence
  Synthetically generated peptide
GTCGEICAACTGC

SEQ ID NO: 305 - protein, 12 aa, Artificial Sequence
  Synthetically generated peptide
GTCGEICACTGC

SEQ ID NO: 306 - protein, 12 aa, Artificial Sequence
  Synthetically generated peptide
GTCGEICAACGC

SEQ ID NO: 307 - protein, 12 aa, Artificial Sequence
  Synthetically generated peptide
GTCGEICAACTC

SEQ ID NO: 308 - protein, 13 aa, Artificial Sequence
  Synthetically generated peptide
GTCGEICAACTGC

SEQ ID NO: 309 - protein, 12 aa, Artificial Sequence
  Synthetically generated peptide
GTCGEICAACGC

SEQ ID NO: 310 - protein, 12 aa, Artificial Sequence
  Synthetically generated peptide
GTCGEICAACTC

SEQ ID NO: 311 - protein, 13 aa, Artificial Sequence
  Synthetically generated peptide
GTCGEICAAACGC

SEQ ID NO: 312 - protein, 12 aa, Artificial Sequence
  Synthetically generated peptide
GTCGEICAAACC

SEQ ID NO: 313 - protein, 13 aa, Artificial Sequence
  Synthetically generated peptide
GTCGEICAAACTC

SEQ ID NO: 314 - protein, 14 aa, Artificial Sequence
  Synthetically generated peptide
GTCGEICAYACTGC

SEQ ID NO: 315 - protein, 13 aa, Artificial Sequence
  Synthetically generated peptide
GTCGEICAYCTGC

SEQ ID NO: 316 - protein, 12 aa, Artificial Sequence
  Synthetically generated peptide
GTCGEICAYCGC

SEQ ID NO: 317 - protein, 12 aa, Artificial Sequence
  Synthetically generated peptide
GTCGEICAYCTC

SEQ ID NO: 318 - protein, 13 aa, Artificial Sequence
  Synthetically generated peptide
GTCGEICAYACGC

SEQ ID NO: 319 - protein, 12 aa, Artificial Sequence
  Synthetically generated peptide
GTCGEICAYACC

SEQ ID NO: 320 - protein, 13 aa, Artificial Sequence
  Synthetically generated peptide
GTCGEICAYACTC

SEQ ID NO: 321 - protein, 14 aa, Artificial Sequence
  Synthetically generated peptide
GTCGEICAYACTGC

SEQ ID NO: 322 - protein, 13 aa, Artificial Sequence
  Synthetically generated peptide
GTCGEICAYACGC

SEQ ID NO: 323 - protein, 12 aa, Artificial Sequence
  Synthetically generated peptide
GTCGEICAYACC

SEQ ID NO: 324 - protein, 13 aa, Artificial Sequence
  Synthetically generated peptide
GTCGEICAYACTC

SEQ ID NO: 325 - protein, 14 aa, Artificial Sequence
  Synthetically generated peptide
GTCGEICAYAACGC

SEQ ID NO: 326 - protein, 13 aa, Artificial Sequence
  Synthetically generated peptide
GTCGEICAYAACC

SEQ ID NO: 327 - protein, 14 aa, Artificial Sequence
  Synthetically generated peptide
GTCGEICAYAACTC

SEQ ID NO: 328 - protein, 15 aa, Artificial Sequence
  Synthetically generated peptide
PTCGEICAYAACTGC

SEQ ID NO: 329 - protein, 14 aa, Artificial Sequence
  Synthetically generated peptide
PCGEICAYAACTGC

SEQ ID NO: 330 - protein, 13 aa, Artificial Sequence
  Synthetically generated peptide
PCEICAYAACTGC

SEQ ID NO: 331 - protein, 12 aa, Artificial Sequence
  Synthetically generated peptide
PCICAYAACTGC

SEQ ID NO: 332 - protein, 12 aa, Artificial Sequence
  Synthetically generated peptide
PCECAYAACTGC

SEQ ID NO: 333 - protein, 12 aa, Artificial Sequence
  Synthetically generated peptide
PCEICYAACTGC

SEQ ID NO: 334 - protein, 12 aa, Artificial Sequence
  Synthetically generated peptide
PCEICAAACTGC

SEQ ID NO: 335 - protein, 12 aa, Artificial Sequence
  Synthetically generated peptide
PCEICAYACTGC

SEQ ID NO: 336 - protein, 12 aa, Artificial Sequence
  Synthetically generated peptide
PCEICAYACTGC

SEQ ID NO: 337 - protein, 12 aa, Artificial Sequence
  Synthetically generated peptide
PCEICAYAACGC

SEQ ID NO: 338 - protein, 12 aa, Artificial Sequence
  Synthetically generated peptide
PCEICAYAACTC

SEQ ID NO: 339 - protein, 13 aa, Artificial Sequence
  Synthetically generated peptide
PCGICAYAACTGC

SEQ ID NO: 340 - protein, 12 aa, Artificial Sequence
  Synthetically generated peptide
PCGCAYAACTGC

SEQ ID NO: 341 - protein, 12 aa, Artificial Sequence
  Synthetically generated peptide
PCGICYAACTGC

SEQ ID NO: 342 - protein, 12 aa, Artificial Sequence
  Synthetically generated peptide
PCGICAAACTGC

SEQ ID NO: 343 - protein, 12 aa, Artificial Sequence
  Synthetically generated peptide
PCGICAYACTGC

SEQ ID NO: 344 - protein, 12 aa, Artificial Sequence
  Synthetically generated peptide
PCGICAYACTGC

SEQ ID NO: 345 - protein, 12 aa, Artificial Sequence
  Synthetically generated peptide
PCGICAYAACGC

SEQ ID NO: 346 - protein, 12 aa, Artificial Sequence
  Synthetically generated peptide
PCGICAYAACTC

SEQ ID NO: 347 - protein, 13 aa, Artificial Sequence
  Synthetically generated peptide
PCGECAYAACTGC

SEQ ID NO: 348 - protein, 12 aa, Artificial Sequence
  Synthetically generated peptide
PCGECYAACTGC

SEQ ID NO: 349 - protein, 12 aa, Artificial Sequence
  Synthetically generated peptide
PCGECAAACTGC

SEQ ID NO: 350 - protein, 12 aa, Artificial Sequence
  Synthetically generated peptide
PCGECAYACTGC

SEQ ID NO: 351 - protein, 12 aa, Artificial Sequence
  Synthetically generated peptide
PCGECAYACTGC

SEQ ID NO: 352 - protein, 12 aa, Artificial Sequence
  Synthetically generated peptide
PCGECAYAACGC

SEQ ID NO: 353 - protein, 12 aa, Artificial Sequence
  Synthetically generated peptide
PCGECAYAACTC

SEQ ID NO: 354 - protein, 13 aa, Artificial Sequence
  Synthetically generated peptide
PCGEICYAACTGC

SEQ ID NO: 355 - protein, 12 aa, Artificial Sequence
  Synthetically generated peptide
PCGEICAACTGC

SEQ ID NO: 356 - protein, 12 aa, Artificial Sequence
  Synthetically generated peptide
PCGEICYACTGC

SEQ ID NO: 357 - protein, 12 aa, Artificial Sequence
  Synthetically generated peptide
PCGEICYACTGC

SEQ ID NO: 358 - protein, 12 aa, Artificial Sequence
  Synthetically generated peptide
PCGEICYAACGC

SEQ ID NO: 359 - protein, 12 aa, Artificial Sequence
  Synthetically generated peptide
PCGEICYAACTC

SEQ ID NO: 360 - protein, 13 aa, Artificial Sequence
  Synthetically generated peptide
PCGEICAAACTGC

SEQ ID NO: 361 - protein, 12 aa, Artificial Sequence
  Synthetically generated peptide
PCGEICAACTGC

SEQ ID NO: 362 - protein, 12 aa, Artificial Sequence
  Synthetically generated peptide
PCGEICAACTGC

SEQ ID NO: 363 - protein, 12 aa, Artificial Sequence
  Synthetically generated peptide
PCGEICAAACGC

SEQ ID NO: 364 - protein, 12 aa, Artificial Sequence
  Synthetically generated peptide
PCGEICAAACTC

SEQ ID NO: 365 - protein, 13 aa, Artificial Sequence
  Synthetically generated peptide
PCGEICAYACTGC

SEQ ID NO: 366 - protein, 12 aa, Artificial Sequence
  Synthetically generated peptide
PCGEICAYCTGC

SEQ ID NO: 367 - protein, 12 aa, Artificial Sequence
  Synthetically generated peptide
PCGEICAYACGC

SEQ ID NO: 368 - protein, 12 aa, Artificial Sequence
  Synthetically generated peptide
PCGEICAYACTC

SEQ ID NO: 369 - protein, 13 aa, Artificial Sequence
  Synthetically generated peptide
PCGEICAYACTGC

SEQ ID NO: 370 - protein, 12 aa, Artificial Sequence
  Synthetically generated peptide
PCGEICAYACGC

SEQ ID NO: 371 - protein, 12 aa, Artificial Sequence
  Synthetically generated peptide
PCGEICAYACTC

SEQ ID NO: 372 - protein, 13 aa, Artificial Sequence
  Synthetically generated peptide
PCGEICAYAACGC

SEQ ID NO: 373 - protein, 12 aa, Artificial Sequence
  Synthetically generated peptide
PCGEICAYAACC

SEQ ID NO: 374 - protein, 13 aa, Artificial Sequence
  Synthetically generated peptide
PCGEICAYAACTC

SEQ ID NO: 375 - protein, 14 aa, Artificial Sequence
  Synthetically generated peptide
PTCEICAYAACTGC

SEQ ID NO: 376 - protein, 13 aa, Artificial Sequence
  Synthetically generated peptide
PTCICAYAACTGC

SEQ ID NO: 377 - protein, 12 aa, Artificial Sequence
  Synthetically generated peptide
PTCCAYAACTGC

SEQ ID NO: 378 - protein, 12 aa, Artificial Sequence
  Synthetically generated peptide
PTCICYAACTGC

SEQ ID NO: 379 - protein, 12 aa, Artificial Sequence
  Synthetically generated peptide
PTCICAAACTGC

SEQ ID NO: 380 - protein, 12 aa, Artificial Sequence
  Synthetically generated peptide
PTCICAYACTGC

SEQ ID NO: 381 - protein, 12 aa, Artificial Sequence
  Synthetically generated peptide
PTCICAYACTGC

SEQ ID NO: 382 - protein, 12 aa, Artificial Sequence
  Synthetically generated peptide
PTCICAYAACGC

SEQ ID NO: 383 - protein, 12 aa, Artificial Sequence
  Synthetically generated peptide
PTCICAYAACTC

SEQ ID NO: 384 - protein, 13 aa, Artificial Sequence
  Synthetically generated peptide
PTCECAYAACTGC

SEQ ID NO: 385 - protein, 12 aa, Artificial Sequence
  Synthetically generated peptide
PTCECYAACTGC

SEQ ID NO: 386 - protein, 12 aa, Artificial Sequence
  Synthetically generated peptide
PTCECAAACTGC

SEQ ID NO: 387 - protein, 12 aa, Artificial Sequence
  Synthetically generated peptide
PTCECAYACTGC

SEQ ID NO: 388 - protein, 12 aa, Artificial Sequence
  Synthetically generated peptide
PTCECAYACTGC

SEQ ID NO: 389 - protein, 12 aa, Artificial Sequence
  Synthetically generated peptide
PTCECAYAACGC

SEQ ID NO: 390 - protein, 12 aa, Artificial Sequence
  Synthetically generated peptide
PTCECAYAACTC

SEQ ID NO: 391 - protein, 13 aa, Artificial Sequence
  Synthetically generated peptide
PTCEICYAACTGC

SEQ ID NO: 392 - protein, 12 aa, Artificial Sequence
  Synthetically generated peptide
PTCEICAACTGC

SEQ ID NO: 393 - protein, 12 aa, Artificial Sequence
  Synthetically generated peptide
PTCEICYACTGC

SEQ ID NO: 394 - protein, 12 aa, Artificial Sequence
  Synthetically generated peptide
PTCEICYACTGC

SEQ ID NO: 395 - protein, 12 aa, Artificial Sequence
  Synthetically generated peptide
PTCEICYAACGC

SEQ ID NO: 396 - protein, 12 aa, Artificial Sequence
  Synthetically generated peptide
PTCEICYAACTC

SEQ ID NO: 397 - protein, 13 aa, Artificial Sequence
  Synthetically generated peptide
PTCEICAAACTGC

SEQ ID NO: 398 - protein, 12 aa, Artificial Sequence
  Synthetically generated peptide
PTCEICAACTGC

SEQ ID NO: 399 - protein, 12 aa, Artificial Sequence
  Synthetically generated peptide
PTCEICAACTGC

SEQ ID NO: 400 - protein, 12 aa, Artificial Sequence
  Synthetically generated peptide
PTCEICAAACGC

SEQ ID NO: 401 - protein, 12 aa, Artificial Sequence
  Synthetically generated peptide
PTCEICAAACTC

SEQ ID NO: 402 - protein, 13 aa, Artificial Sequence
  Synthetically generated peptide
PTCEICAYACTGC

SEQ ID NO: 403 - protein, 12 aa, Artificial Sequence
  Synthetically generated peptide
PTCEICAYCTGC

SEQ ID NO: 404 - protein, 12 aa, Artificial Sequence
  Synthetically generated peptide
PTCEICAYACGC

SEQ ID NO: 405 - protein, 12 aa, Artificial Sequence
  Synthetically generated peptide
PTCEICAYACTC

SEQ ID NO: 406 - protein, 13 aa, Artificial Sequence
  Synthetically generated peptide
PTCEICAYACTGC

SEQ ID NO: 407 - protein, 12 aa, Artificial Sequence
  Synthetically generated peptide
PTCEICAYACGC

SEQ ID NO: 408 - protein, 12 aa, Artificial Sequence
  Synthetically generated peptide
PTCEICAYACTC

SEQ ID NO: 409 - protein, 13 aa, Artificial Sequence
  Synthetically generated peptide
PTCEICAYAACGC

SEQ ID NO: 410 - protein, 12 aa, Artificial Sequence
  Synthetically generated peptide
PTCEICAYAACC

SEQ ID NO: 411 - protein, 13 aa, Artificial Sequence
  Synthetically generated peptide
PTCEICAYAACTC

SEQ ID NO: 412 - protein, 14 aa, Artificial Sequence
  Synthetically generated peptide
PTCGICAYAACTGC

SEQ ID NO: 413 - protein, 13 aa, Artificial Sequence
  Synthetically generated peptide
PTCGCAYAACTGC

SEQ ID NO: 414 - protein, 12 aa, Artificial Sequence
  Synthetically generated peptide
PTCGCYAACTGC

SEQ ID NO: 415 - protein, 12 aa, Artificial Sequence
  Synthetically generated peptide
PTCGCAAACTGC

SEQ ID NO: 416 - protein, 12 aa, Artificial Sequence
  Synthetically generated peptide
PTCGCAYACTGC

SEQ ID NO: 417 - protein, 12 aa, Artificial Sequence
  Synthetically generated peptide
PTCGCAYACTGC

SEQ ID NO: 418 - protein, 12 aa, Artificial Sequence
  Synthetically generated peptide
PTCGCAYAACGC

SEQ ID NO: 419 - protein, 12 aa, Artificial Sequence
  Synthetically generated peptide
PTCGCAYAACTC

SEQ ID NO: 420 - protein, 13 aa, Artificial Sequence
  Synthetically generated peptide
PTCGICYAACTGC

SEQ ID NO: 421 - protein, 12 aa, Artificial Sequence
  Synthetically generated peptide
PTCGICAACTGC

SEQ ID NO: 422 - protein, 12 aa, Artificial Sequence
  Synthetically generated peptide
PTCGICYACTGC

SEQ ID NO: 423 - protein, 12 aa, Artificial Sequence
  Synthetically generated peptide
PTCGICYACTGC

SEQ ID NO: 424 - protein, 12 aa, Artificial Sequence
  Synthetically generated peptide
PTCGICYAACGC

SEQ ID NO: 425 - protein, 12 aa, Artificial Sequence
  Synthetically generated peptide
PTCGICYAACTC

SEQ ID NO: 426 - protein, 13 aa, Artificial Sequence
  Synthetically generated peptide
PTCGICAAACTGC

SEQ ID NO: 427 - protein, 12 aa, Artificial Sequence
  Synthetically generated peptide
PTCGICAACTGC

SEQ ID NO: 428 - protein, 12 aa, Artificial Sequence
  Synthetically generated peptide
PTCGICAACTGC

SEQ ID NO: 429 - protein, 12 aa, Artificial Sequence
  Synthetically generated peptide
PTCGICAAACGC

SEQ ID NO: 430 - protein, 12 aa, Artificial Sequence
  Synthetically generated peptide
PTCGICAAACTC

SEQ ID NO: 431 - protein, 13 aa, Artificial Sequence
  Synthetically generated peptide
PTCGICAYACTGC

SEQ ID NO: 432 - protein, 12 aa, Artificial Sequence
  Synthetically generated peptide
PTCGICAYCTGC

SEQ ID NO: 433 - protein, 12 aa, Artificial Sequence
  Synthetically generated peptide
PTCGICAYACGC

SEQ ID NO: 434 - protein, 12 aa, Artificial Sequence
  Synthetically generated peptide
PTCGICAYACTC

SEQ ID NO: 435 - protein, 13 aa, Artificial Sequence
  Synthetically generated peptide
PTCGICAYACTGC

SEQ ID NO: 436 - protein, 12 aa, Artificial Sequence
  Synthetically generated peptide
PTCGICAYACGC

SEQ ID NO: 437 - protein, 12 aa, Artificial Sequence
  Synthetically generated peptide
PTCGICAYACTC

SEQ ID NO: 438 - protein, 13 aa, Artificial Sequence
  Synthetically generated peptide
PTCGICAYAACGC

SEQ ID NO: 439 - protein, 12 aa, Artificial Sequence
  Synthetically generated peptide
PTCGICAYAACC

SEQ ID NO: 440 - protein, 13 aa, Artificial Sequence
  Synthetically generated peptide
PTCGICAYAACTC

SEQ ID NO: 441 - protein, 14 aa, Artificial Sequence
  Synthetically generated peptide
PTCGECAYAACTGC

SEQ ID NO: 442 - protein, 13 aa, Artificial Sequence
  Synthetically generated peptide
PTCGECYAACTGC

SEQ ID NO: 443 - protein, 12 aa, Artificial Sequence
  Synthetically generated peptide
PTCGECAACTGC

SEQ ID NO: 444 - protein, 12 aa, Artificial Sequence
  Synthetically generated peptide
PTCGECYACTGC

SEQ ID NO: 445 - protein, 12 aa, Artificial Sequence
  Synthetically generated peptide
PTCGECYACTGC

SEQ ID NO: 446 - protein, 12 aa, Artificial Sequence
  Synthetically generated peptide
PTCGECYAACGC

SEQ ID NO: 447 - protein, 12 aa, Artificial Sequence
  Synthetically generated peptide
PTCGECYAACTC

SEQ ID NO: 448 - protein, 13 aa, Artificial Sequence
  Synthetically generated peptide
PTCGECAAACTGC

SEQ ID NO: 449 - protein, 12 aa, Artificial Sequence
  Synthetically generated peptide
PTCGECAACTGC

SEQ ID NO: 450 - protein, 12 aa, Artificial Sequence
  Synthetically generated peptide
PTCGECAACTGC

SEQ ID NO: 451 - protein, 12 aa, Artificial Sequence
  Synthetically generated peptide
PTCGECAAACGC

SEQ ID NO: 452 - protein, 12 aa, Artificial Sequence
  Synthetically generated peptide
PTCGECAAACTC

SEQ ID NO: 453 - protein, 13 aa, Artificial Sequence
  Synthetically generated peptide
PTCGECAYACTGC

SEQ ID NO: 454 - protein, 12 aa, Artificial Sequence
  Synthetically generated peptide
PTCGECAYCTGC

SEQ ID NO: 455 - protein, 12 aa, Artificial Sequence
  Synthetically generated peptide
PTCGECAYACGC

SEQ ID NO: 456 - protein, 12 aa, Artificial Sequence
  Synthetically generated peptide
PTCGECAYACTC

SEQ ID NO: 457 - protein, 13 aa, Artificial Sequence
  Synthetically generated peptide
PTCGECAYACTGC

SEQ ID NO: 458 - protein, 12 aa, Artificial Sequence
  Synthetically generated peptide
PTCGECAYACGC

SEQ ID NO: 459 - protein, 12 aa, Artificial Sequence
  Synthetically generated peptide
PTCGECAYACTC

SEQ ID NO: 460 - protein, 13 aa, Artificial Sequence
  Synthetically generated peptide
PTCGECAYAACGC

SEQ ID NO: 461 - protein, 12 aa, Artificial Sequence
  Synthetically generated peptide
PTCGECAYAACC

SEQ ID NO: 462 - protein, 13 aa, Artificial Sequence
  Synthetically generated peptide
PTCGECAYAACTC

SEQ ID NO: 463 - protein, 14 aa, Artificial Sequence
  Synthetically generated peptide
PTCGEICYAACTGC

SEQ ID NO: 464 - protein, 13 aa, Artificial Sequence
  Synthetically generated peptide
PTCGEICAACTGC

SEQ ID NO: 465 - protein, 12 aa, Artificial Sequence
  Synthetically generated peptide
PTCGEICACTGC

SEQ ID NO: 466 - protein, 12 aa, Artificial Sequence
  Synthetically generated peptide
PTCGEICACTGC

SEQ ID NO: 467 - protein, 12 aa, Artificial Sequence
  Synthetically generated peptide
PTCGEICAACGC

SEQ ID NO: 468 - protein, 12 aa, Artificial Sequence
  Synthetically generated peptide
PTCGEICAACTC

SEQ ID NO: 469 - protein, 13 aa, Artificial Sequence
  Synthetically generated peptide
PTCGEICYACTGC

SEQ ID NO: 470 - protein, 12 aa, Artificial Sequence
  Synthetically generated peptide
PTCGEICYCTGC

SEQ ID NO: 471 - protein, 12 aa, Artificial Sequence
  Synthetically generated peptide
PTCGEICYACGC

SEQ ID NO: 472 - protein, 12 aa, Artificial Sequence
  Synthetically generated peptide
PTCGEICYACTC

SEQ ID NO: 473 - protein, 13 aa, Artificial Sequence
  Synthetically generated peptide
PTCGEICYACTGC

SEQ ID NO: 474 - protein, 12 aa, Artificial Sequence
  Synthetically generated peptide
PTCGEICYACGC

SEQ ID NO: 475 - protein, 12 aa, Artificial Sequence
  Synthetically generated peptide
PTCGEICYACTC

SEQ ID NO: 476 - protein, 13 aa, Artificial Sequence
  Synthetically generated peptide
PTCGEICYAACGC

SEQ ID NO: 477 - protein, 12 aa, Artificial Sequence
  Synthetically generated peptide
PTCGEICYAACC

SEQ ID NO: 478 - protein, 13 aa, Artificial Sequence
  Synthetically generated peptide
PTCGEICYAACTC

SEQ ID NO: 479 - protein, 14 aa, Artificial Sequence
  Synthetically generated peptide
PTCGEICAAACTGC

SEQ ID NO: 480 - protein, 13 aa, Artificial Sequence
  Synthetically generated peptide
PTCGEICAACTGC

SEQ ID NO: 481 - protein, 12 aa, Artificial Sequence
  Synthetically generated peptide
PTCGEICACTGC

SEQ ID NO: 482 - protein, 12 aa, Artificial Sequence
  Synthetically generated peptide
PTCGEICAACGC

SEQ ID NO: 483 - protein, 12 aa, Artificial Sequence
  Synthetically generated peptide
PTCGEICAACTC

SEQ ID NO: 484 - protein, 13 aa, Artificial Sequence
  Synthetically generated peptide
PTCGEICAACTGC

SEQ ID NO: 485 - protein, 12 aa, Artificial Sequence
  Synthetically generated peptide
PTCGEICAACGC

SEQ ID NO: 486 - protein, 12 aa, Artificial Sequence
  Synthetically generated peptide
PTCGEICAACTC

SEQ ID NO: 487 - protein, 13 aa, Artificial Sequence
  Synthetically generated peptide
PTCGEICAAACGC

SEQ ID NO: 488 - protein, 12 aa, Artificial Sequence
  Synthetically generated peptide
PTCGEICAAACC

SEQ ID NO: 489 - protein, 13 aa, Artificial Sequence
  Synthetically generated peptide
PTCGEICAAACTC

SEQ ID NO: 490 - protein, 14 aa, Artificial Sequence
  Synthetically generated peptide
PTCGEICAYACTGC

SEQ ID NO: 491 - protein, 13 aa, Artificial Sequence
  Synthetically generated peptide
PTCGEICAYCTGC

SEQ ID NO: 492 - protein, 12 aa, Artificial Sequence
  Synthetically generated peptide
PTCGEICAYCGC

SEQ ID NO: 493 - protein, 12 aa, Artificial Sequence
  Synthetically generated peptide
PTCGEICAYCTC

SEQ ID NO: 494 - protein, 13 aa, Artificial Sequence
  Synthetically generated peptide
PTCGEICAYACGC

SEQ ID NO: 495 - protein, 12 aa, Artificial Sequence
  Synthetically generated peptide
PTCGEICAYACC

SEQ ID NO: 496 - protein, 13 aa, Artificial Sequence
  Synthetically generated peptide
PTCGEICAYACTC

SEQ ID NO: 497 - protein, 14 aa, Artificial Sequence
  Synthetically generated peptide
PTCGEICAYACTGC

SEQ ID NO: 498 - protein, 13 aa, Artificial Sequence
  Synthetically generated peptide
PTCGEICAYACGC

SEQ ID NO: 499 - protein, 12 aa, Artificial Sequence
  Synthetically generated peptide
PTCGEICAYACC

SEQ ID NO: 500 - protein, 13 aa, Artificial Sequence
  Synthetically generated peptide
PTCGEICAYACTC

SEQ ID NO: 501 - protein, 14 aa, Artificial Sequence
  Synthetically generated peptide
PTCGEICAYAACGC

SEQ ID NO: 502 - protein, 13 aa, Artificial Sequence
  Synthetically generated peptide
PTCGEICAYAACC

SEQ ID NO: 503 - protein, 14 aa, Artificial Sequence
  Synthetically generated peptide
PTCGEICAYAACTC

SEQ ID NO: 504 - protein, 15 aa, Artificial Sequence
  Synthetically generated peptide
PGCGEICAYAACTGC

SEQ ID NO: 505 - protein, 14 aa, Artificial Sequence
  Synthetically generated peptide
PGCEICAYAACTGC

SEQ ID NO: 506 - protein, 13 aa, Artificial Sequence
  Synthetically generated peptide
PGCICAYAACTGC

SEQ ID NO: 507 - protein, 12 aa, Artificial Sequence
  Synthetically generated peptide
PGCCAYAACTGC

SEQ ID NO: 508 - protein, 12 aa, Artificial Sequence
  Synthetically generated peptide
PGCICYAACTGC

SEQ ID NO: 509 - protein, 12 aa, Artificial Sequence
  Synthetically generated peptide
PGCICAAACTGC

SEQ ID NO: 510 - protein, 12 aa, Artificial Sequence
  Synthetically generated peptide
PGCICAYACTGC

SEQ ID NO: 511 - protein, 12 aa, Artificial Sequence
  Synthetically generated peptide
PGCICAYACTGC

SEQ ID NO: 512 - protein, 12 aa, Artificial Sequence
  Synthetically generated peptide
PGCICAYAACGC

SEQ ID NO: 513 - protein, 12 aa, Artificial Sequence
  Synthetically generated peptide
PGCICAYAACTC

SEQ ID NO: 514 - protein, 13 aa, Artificial Sequence
  Synthetically generated peptide
PGCECAYAACTGC

SEQ ID NO: 515 - protein, 12 aa, Artificial Sequence
  Synthetically generated peptide
PGCECYAACTGC

SEQ ID NO: 516 - protein, 12 aa, Artificial Sequence
  Synthetically generated peptide
PGCECAAACTGC

SEQ ID NO: 517 - protein, 12 aa, Artificial Sequence
  Synthetically generated peptide
PGCECAYACTGC

SEQ ID NO: 518 - protein, 12 aa, Artificial Sequence
  Synthetically generated peptide
PGCECAYACTGC

SEQ ID NO: 519 - protein, 12 aa, Artificial Sequence
  Synthetically generated peptide
PGCECAYAACGC

SEQ ID NO: 520 - protein, 12 aa, Artificial Sequence
  Synthetically generated peptide
PGCECAYAACTC

SEQ ID NO: 521 - protein, 13 aa, Artificial Sequence
  Synthetically generated peptide
PGCEICYAACTGC

SEQ ID NO: 522 - protein, 12 aa, Artificial Sequence
  Synthetically generated peptide
PGCEICAACTGC

SEQ ID NO: 523 - protein, 12 aa, Artificial Sequence
  Synthetically generated peptide
PGCEICYACTGC

SEQ ID NO: 524 - protein, 12 aa, Artificial Sequence
  Synthetically generated peptide
PGCEICYACTGC

SEQ ID NO: 525 - protein, 12 aa, Artificial Sequence
  Synthetically generated peptide
PGCEICYAACGC

SEQ ID NO: 526 - protein, 12 aa, Artificial Sequence
  Synthetically generated peptide
PGCEICYAACTC

SEQ ID NO: 527 - protein, 13 aa, Artificial Sequence
  Synthetically generated peptide
PGCEICAAACTGC

SEQ ID NO: 528 - protein, 12 aa, Artificial Sequence
  Synthetically generated peptide
PGCEICAACTGC

SEQ ID NO: 529 - protein, 12 aa, Artificial Sequence
  Synthetically generated peptide
PGCEICAACTGC

SEQ ID NO: 530 - protein, 12 aa, Artificial Sequence
  Synthetically generated peptide
PGCEICAAACGC

SEQ ID NO: 531 - protein, 12 aa, Artificial Sequence
  Synthetically generated peptide
PGCEICAAACTC

SEQ ID NO: 532 - protein, 13 aa, Artificial Sequence
  Synthetically generated peptide
PGCEICAYACTGC

SEQ ID NO: 533 - protein, 12 aa, Artificial Sequence
  Synthetically generated peptide
PGCEICAYCTGC

SEQ ID NO: 534 - protein, 12 aa, Artificial Sequence
  Synthetically generated peptide
PGCEICAYACGC

SEQ ID NO: 535 - protein, 12 aa, Artificial Sequence
  Synthetically generated peptide
PGCEICAYACTC

SEQ ID NO: 536 - protein, 13 aa, Artificial Sequence
  Synthetically generated peptide
PGCEICAYACTGC

SEQ ID NO: 537 - protein, 12 aa, Artificial Sequence
  Synthetically generated peptide
PGCEICAYACGC

SEQ ID NO: 538 - protein, 12 aa, Artificial Sequence
  Synthetically generated peptide
PGCEICAYACTC

SEQ ID NO: 539 - protein, 13 aa, Artificial Sequence
  Synthetically generated peptide
PGCEICAYAACGC

SEQ ID NO: 540 - protein, 12 aa, Artificial Sequence
  Synthetically generated peptide
PGCEICAYAACC

SEQ ID NO: 541 - protein, 13 aa, Artificial Sequence
  Synthetically generated peptide
PGCEICAYAACTC

SEQ ID NO: 542 - protein, 14 aa, Artificial Sequence
  Synthetically generated peptide
PGCGICAYAACTGC

SEQ ID NO: 543 - protein, 13 aa, Artificial Sequence
  Synthetically generated peptide
PGCGCAYAACTGC

SEQ ID NO: 544 - protein, 12 aa, Artificial Sequence
  Synthetically generated peptide
PGCGCYAACTGC

SEQ ID NO: 545 - protein, 12 aa, Artificial Sequence
  Synthetically generated peptide
PGCGCAAACTGC

SEQ ID NO: 546 - protein, 12 aa, Artificial Sequence
  Synthetically generated peptide
PGCGCAYACTGC

SEQ ID NO: 547 - protein, 12 aa, Artificial Sequence
  Synthetically generated peptide
PGCGCAYACTGC

SEQ ID NO: 548 - protein, 12 aa, Artificial Sequence
  Synthetically generated peptide
PGCGCAYAACGC

SEQ ID NO: 549 - protein, 12 aa, Artificial Sequence
  Synthetically generated peptide
PGCGCAYAACTC

SEQ ID NO: 550 - protein, 13 aa, Artificial Sequence
  Synthetically generated peptide
PGCGICYAACTGC

SEQ ID NO: 551 - protein, 12 aa, Artificial Sequence
  Synthetically generated peptide
PGCGICAACTGC

SEQ ID NO: 552 - protein, 12 aa, Artificial Sequence
  Synthetically generated peptide
PGCGICYACTGC

SEQ ID NO: 553 - protein, 12 aa, Artificial Sequence
  Synthetically generated peptide
PGCGICYACTGC

SEQ ID NO: 554 - protein, 12 aa, Artificial Sequence
  Synthetically generated peptide
PGCGICYAACGC

SEQ ID NO: 555 - protein, 12 aa, Artificial Sequence
  Synthetically generated peptide
PGCGICYAACTC

SEQ ID NO: 556 - protein, 13 aa, Artificial Sequence
  Synthetically generated peptide
PGCGICAAACTGC

SEQ ID NO: 557 - protein, 12 aa, Artificial Sequence
  Synthetically generated peptide
PGCGICAACTGC

SEQ ID NO: 558 - protein, 12 aa, Artificial Sequence
  Synthetically generated peptide
PGCGICAACTGC

SEQ ID NO: 559 - protein, 12 aa, Artificial Sequence
  Synthetically generated peptide
PGCGICAAACGC

SEQ ID NO: 560 - protein, 12 aa, Artificial Sequence
  Synthetically generated peptide
PGCGICAAACTC

SEQ ID NO: 561 - protein, 13 aa, Artificial Sequence
  Synthetically generated peptide
PGCGICAYACTGC

SEQ ID NO: 562 - protein, 12 aa, Artificial Sequence
  Synthetically generated peptide
PGCGICAYCTGC

SEQ ID NO: 563 - protein, 12 aa, Artificial Sequence
  Synthetically generated peptide
PGCGICAYACGC

SEQ ID NO: 564 - protein, 12 aa, Artificial Sequence
  Synthetically generated peptide
PGCGICAYACTC

SEQ ID NO: 565 - protein, 13 aa, Artificial Sequence
  Synthetically generated peptide
PGCGICAYACTGC

SEQ ID NO: 566 - protein, 12 aa, Artificial Sequence
  Synthetically generated peptide
PGCGICAYACGC

SEQ ID NO: 567 - protein, 12 aa, Artificial Sequence
  Synthetically generated peptide
PGCGICAYACTC

SEQ ID NO: 568 - protein, 13 aa, Artificial Sequence
  Synthetically generated peptide
PGCGICAYAACGC

SEQ ID NO: 569 - protein, 12 aa, Artificial Sequence
  Synthetically generated peptide
PGCGICAYAACC

SEQ ID NO: 570 - protein, 13 aa, Artificial Sequence
  Synthetically generated peptide
PGCGICAYAACTC

SEQ ID NO: 571 - protein, 14 aa, Artificial Sequence
  Synthetically generated peptide
PGCGECAYAACTGC

SEQ ID NO: 572 - protein, 13 aa, Artificial Sequence
  Synthetically generated peptide
PGCGECYAACTGC

SEQ ID NO: 573 - protein, 12 aa, Artificial Sequence
  Synthetically generated peptide
PGCGECAACTGC

SEQ ID NO: 574 - protein, 12 aa, Artificial Sequence
  Synthetically generated peptide
PGCGECYACTGC

SEQ ID NO: 575 - protein, 12 aa, Artificial Sequence
  Synthetically generated peptide
PGCGECYACTGC

SEQ ID NO: 576 - protein, 12 aa, Artificial Sequence
  Synthetically generated peptide
PGCGECYAACGC

SEQ ID NO: 577 - protein, 12 aa, Artificial Sequence
  Synthetically generated peptide
PGCGECYAACTC

SEQ ID NO: 578 - protein, 13 aa, Artificial Sequence
  Synthetically generated peptide
PGCGECAAACTGC

SEQ ID NO: 579 - protein, 12 aa, Artificial Sequence
  Synthetically generated peptide
PGCGECAACTGC

SEQ ID NO: 580 - protein, 12 aa, Artificial Sequence
  Synthetically generated peptide
PGCGECAACTGC

SEQ ID NO: 581 - protein, 12 aa, Artificial Sequence
  Synthetically generated peptide
PGCGECAAACGC

SEQ ID NO: 582 - protein, 12 aa, Artificial Sequence
  Synthetically generated peptide
PGCGECAAACTC

SEQ ID NO: 583 - protein, 13 aa, Artificial Sequence
  Synthetically generated peptide
PGCGECAYACTGC

SEQ ID NO: 584 - protein, 12 aa, Artificial Sequence
  Synthetically generated peptide
PGCGECAYCTGC

SEQ ID NO: 585 - protein, 12 aa, Artificial Sequence
  Synthetically generated peptide
PGCGECAYACGC

SEQ ID NO: 586 - protein, 12 aa, Artificial Sequence
  Synthetically generated peptide
PGCGECAYACTC

SEQ ID NO: 587 - protein, 13 aa, Artificial Sequence
  Synthetically generated peptide
PGCGECAYACTGC

SEQ ID NO: 588 - protein, 12 aa, Artificial Sequence
  Synthetically generated peptide
PGCGECAYACGC

SEQ ID NO: 589 - protein, 12 aa, Artificial Sequence
  Synthetically generated peptide
PGCGECAYACTC

SEQ ID NO: 590 - protein, 13 aa, Artificial Sequence
  Synthetically generated peptide
PGCGECAYAACGC

SEQ ID NO: 591 - protein, 12 aa, Artificial Sequence
  Synthetically generated peptide
PGCGECAYAACC

SEQ ID NO: 592 - protein, 13 aa, Artificial Sequence
  Synthetically generated peptide
PGCGECAYAACTC

SEQ ID NO: 593 - protein, 14 aa, Artificial Sequence
  Synthetically generated peptide
PGCGEICYAACTGC

SEQ ID NO: 594 - protein, 13 aa, Artificial Sequence
  Synthetically generated peptide
PGCGEICAACTGC

SEQ ID NO: 595 - protein, 12 aa, Artificial Sequence
  Synthetically generated peptide
PGCGEICACTGC

SEQ ID NO: 596 - protein, 12 aa, Artificial Sequence
  Synthetically generated peptide
PGCGEICACTGC

SEQ ID NO: 597 - protein, 12 aa, Artificial Sequence
  Synthetically generated peptide
PGCGEICAACGC

SEQ ID NO: 598 - protein, 12 aa, Artificial Sequence
  Synthetically generated peptide
PGCGEICAACTC

SEQ ID NO: 599 - protein, 13 aa, Artificial Sequence
  Synthetically generated peptide
PGCGEICYACTGC

SEQ ID NO: 600 - protein, 12 aa, Artificial Sequence
  Synthetically generated peptide
PGCGEICYCTGC

SEQ ID NO: 601 - protein, 12 aa, Artificial Sequence
  Synthetically generated peptide
PGCGEICYACGC

SEQ ID NO: 602 - protein, 12 aa, Artificial Sequence
  Synthetically generated peptide
PGCGEICYACTC

SEQ ID NO: 603 - protein, 13 aa, Artificial Sequence
  Synthetically generated peptide
PGCGEICYACTGC

SEQ ID NO: 604 - protein, 12 aa, Artificial Sequence
  Synthetically generated peptide
PGCGEICYACGC

SEQ ID NO: 605 - protein, 12 aa, Artificial Sequence
  Synthetically generated peptide
PGCGEICYACTC

SEQ ID NO: 606 - protein, 13 aa, Artificial Sequence
  Synthetically generated peptide
PGCGEICYAACGC

SEQ ID NO: 607 - protein, 12 aa, Artificial Sequence
  Synthetically generated peptide
PGCGEICYAACC

SEQ ID NO: 608 - protein, 13 aa, Artificial Sequence
  Synthetically generated peptide
PGCGEICYAACTC

SEQ ID NO: 609 - protein, 14 aa, Artificial Sequence
  Synthetically generated peptide
PGCGEICAAACTGC

SEQ ID NO: 610 - protein, 13 aa, Artificial Sequence
  Synthetically generated peptide
PGCGEICAACTGC

SEQ ID NO: 611 - protein, 12 aa, Artificial Sequence
  Synthetically generated peptide
PGCGEICACTGC

SEQ ID NO: 612 - protein, 12 aa, Artificial Sequence
  Synthetically generated peptide
PGCGEICAACGC

SEQ ID NO: 613 - protein, 12 aa, Artificial Sequence
  Synthetically generated peptide
PGCGEICAACTC

SEQ ID NO: 614 - protein, 13 aa, Artificial Sequence
  Synthetically generated peptide
PGCGEICAACTGC

SEQ ID NO: 615 - protein, 12 aa, Artificial Sequence
  Synthetically generated peptide
PGCGEICAACGC

SEQ ID NO: 616 - protein, 12 aa, Artificial Sequence
  Synthetically generated peptide
PGCGEICAACTC

SEQ ID NO: 617 - protein, 13 aa, Artificial Sequence
  Synthetically generated peptide
PGCGEICAAACGC

SEQ ID NO: 618 - protein, 12 aa, Artificial Sequence
  Synthetically generated peptide
PGCGEICAAACC

SEQ ID NO: 619 - protein, 13 aa, Artificial Sequence
  Synthetically generated peptide
PGCGEICAAACTC

SEQ ID NO: 620 - protein, 14 aa, Artificial Sequence
  Synthetically generated peptide
PGCGEICAYACTGC

SEQ ID NO: 621 - protein, 13 aa, Artificial Sequence
  Synthetically generated peptide
PGCGEICAYCTGC

SEQ ID NO: 622 - protein, 12 aa, Artificial Sequence
  Synthetically generated peptide
PGCGEICAYCGC

SEQ ID NO: 623 - protein, 12 aa, Artificial Sequence
  Synthetically generated peptide
PGCGEICAYCTC

SEQ ID NO: 624 - protein, 13 aa, Artificial Sequence
  Synthetically generated peptide
PGCGEICAYACGC

SEQ ID NO: 625 - protein, 12 aa, Artificial Sequence
  Synthetically generated peptide
PGCGEICAYACC

SEQ ID NO: 626 - protein, 13 aa, Artificial Sequence
  Synthetically generated peptide
PGCGEICAYACTC

SEQ ID NO: 627 - protein, 14 aa, Artificial Sequence
  Synthetically generated peptide
PGCGEICAYACTGC

SEQ ID NO: 628 - protein, 13 aa, Artificial Sequence
  Synthetically generated peptide
PGCGEICAYACGC

SEQ ID NO: 629 - protein, 12 aa, Artificial Sequence
  Synthetically generated peptide
PGCGEICAYACC

SEQ ID NO: 630 - protein, 13 aa, Artificial Sequence
  Synthetically generated peptide
PGCGEICAYACTC

SEQ ID NO: 631 - protein, 14 aa, Artificial Sequence
  Synthetically generated peptide
PGCGEICAYAACGC

SEQ ID NO: 632 - protein, 13 aa, Artificial Sequence
  Synthetically generated peptide
PGCGEICAYAACC

SEQ ID NO: 633 - protein, 14 aa, Artificial Sequence
  Synthetically generated peptide
PGCGEICAYAACTC

SEQ ID NO: 634 - protein, 15 aa, Artificial Sequence
  Synthetically generated peptide
PGTCEICAYAACTGC

SEQ ID NO: 635 - protein, 14 aa, Artificial Sequence
  Synthetically generated peptide
PGTCICAYAACTGC

SEQ ID NO: 636 - protein, 13 aa, Artificial Sequence
  Synthetically generated peptide
PGTCCAYAACTGC

SEQ ID NO: 637 - protein, 12 aa, Artificial Sequence
  Synthetically generated peptide
PGTCCYAACTGC

SEQ ID NO: 638 - protein, 12 aa, Artificial Sequence
  Synthetically generated peptide
PGTCCAAACTGC

SEQ ID NO: 639 - protein, 12 aa, Artificial Sequence
  Synthetically generated peptide
PGTCCAYACTGC

SEQ ID NO: 640 - protein, 12 aa, Artificial Sequence
  Synthetically generated peptide
PGTCCAYACTGC

SEQ ID NO: 641 - protein, 12 aa, Artificial Sequence
  Synthetically generated peptide
PGTCCAYAACGC

SEQ ID NO: 642 - protein, 12 aa, Artificial Sequence
  Synthetically generated peptide
PGTCCAYAACTC

SEQ ID NO: 643 - protein, 13 aa, Artificial Sequence
  Synthetically generated peptide
PGTCICYAACTGC

SEQ ID NO: 644 - protein, 12 aa, Artificial Sequence
  Synthetically generated peptide
PGTCICAACTGC

SEQ ID NO: 645 - protein, 12 aa, Artificial Sequence
  Synthetically generated peptide
PGTCICYACTGC

SEQ ID NO: 646 - protein, 12 aa, Artificial Sequence
  Synthetically generated peptide
PGTCICYACTGC

SEQ ID NO: 647 - protein, 12 aa, Artificial Sequence
  Synthetically generated peptide
PGTCICYAACGC

SEQ ID NO: 648 - protein, 12 aa, Artificial Sequence
  Synthetically generated peptide
PGTCICYAACTC

SEQ ID NO: 649 - protein, 13 aa, Artificial Sequence
  Synthetically generated peptide
PGTCICAAACTGC

SEQ ID NO: 650 - protein, 12 aa, Artificial Sequence
  Synthetically generated peptide
PGTCICAACTGC

SEQ ID NO: 651 - protein, 12 aa, Artificial Sequence
  Synthetically generated peptide
PGTCICAACTGC

SEQ ID NO: 652 - protein, 12 aa, Artificial Sequence
  Synthetically generated peptide
PGTCICAAACGC

SEQ ID NO: 653 - protein, 12 aa, Artificial Sequence
  Synthetically generated peptide
PGTCICAAACTC

SEQ ID NO: 654 - protein, 13 aa, Artificial Sequence
  Synthetically generated peptide
PGTCICAYACTGC

SEQ ID NO: 655 - protein, 12 aa, Artificial Sequence
  Synthetically generated peptide
PGTCICAYCTGC

SEQ ID NO: 656 - protein, 12 aa, Artificial Sequence
  Synthetically generated peptide
PGTCICAYACGC

SEQ ID NO: 657 - protein, 12 aa, Artificial Sequence
  Synthetically generated peptide
PGTCICAYACTC

SEQ ID NO: 658 - protein, 13 aa, Artificial Sequence
  Synthetically generated peptide
PGTCICAYACTGC

SEQ ID NO: 659 - protein, 12 aa, Artificial Sequence
  Synthetically generated peptide
PGTCICAYACGC

SEQ ID NO: 660 - protein, 12 aa, Artificial Sequence
  Synthetically generated peptide
PGTCICAYACTC

SEQ ID NO: 661 - protein, 13 aa, Artificial Sequence
  Synthetically generated peptide
PGTCICAYAACGC

SEQ ID NO: 662 - protein, 12 aa, Artificial Sequence
  Synthetically generated peptide
PGTCICAYAACC

SEQ ID NO: 663 - protein, 13 aa, Artificial Sequence
  Synthetically generated peptide
PGTCICAYAACTC

SEQ ID NO: 664 - protein, 14 aa, Artificial Sequence
  Synthetically generated peptide
PGTCECAYAACTGC

SEQ ID NO: 665 - protein, 13 aa, Artificial Sequence
  Synthetically generated peptide
PGTCECYAACTGC

SEQ ID NO: 666 - protein, 12 aa, Artificial Sequence
  Synthetically generated peptide
PGTCECAACTGC

SEQ ID NO: 667 - protein, 12 aa, Artificial Sequence
  Synthetically generated peptide
PGTCECYACTGC

SEQ ID NO: 668 - protein, 12 aa, Artificial Sequence
  Synthetically generated peptide
PGTCECYACTGC

SEQ ID NO: 669 - protein, 12 aa, Artificial Sequence
  Synthetically generated peptide
PGTCECYAACGC

SEQ ID NO: 670 - protein, 12 aa, Artificial Sequence
  Synthetically generated peptide
PGTCECYAACTC

SEQ ID NO: 671 - protein, 13 aa, Artificial Sequence
  Synthetically generated peptide
PGTCECAAACTGC

SEQ ID NO: 672 - protein, 12 aa, Artificial Sequence
  Synthetically generated peptide
PGTCECAACTGC

SEQ ID NO: 673 - protein, 12 aa, Artificial Sequence
  Synthetically generated peptide
PGTCECAACTGC

SEQ ID NO: 674 - protein, 12 aa, Artificial Sequence
  Synthetically generated peptide
PGTCECAAACGC

SEQ ID NO: 675 - protein, 12 aa, Artificial Sequence
  Synthetically generated peptide
PGTCECAAACTC

SEQ ID NO: 676 - protein, 13 aa, Artificial Sequence
  Synthetically generated peptide
PGTCECAYACTGC

SEQ ID NO: 677 - protein, 12 aa, Artificial Sequence
  Synthetically generated peptide
PGTCECAYCTGC

SEQ ID NO: 678 - protein, 12 aa, Artificial Sequence
  Synthetically generated peptide
PGTCECAYACGC

SEQ ID NO: 679 - protein, 12 aa, Artificial Sequence
  Synthetically generated peptide
PGTCECAYACTC

SEQ ID NO: 680 - protein, 13 aa, Artificial Sequence
  Synthetically generated peptide
PGTCECAYACTGC

SEQ ID NO: 681 - protein, 12 aa, Artificial Sequence
  Synthetically generated peptide
PGTCECAYACGC

SEQ ID NO: 682 - protein, 12 aa, Artificial Sequence
  Synthetically generated peptide
PGTCECAYACTC

SEQ ID NO: 683 - protein, 13 aa, Artificial Sequence
  Synthetically generated peptide
PGTCECAYAACGC

SEQ ID NO: 684 - protein, 12 aa, Artificial Sequence
  Synthetically generated peptide
PGTCECAYAACC

SEQ ID NO: 685 - protein, 13 aa, Artificial Sequence
  Synthetically generated peptide
PGTCECAYAACTC

SEQ ID NO: 686 - protein, 14 aa, Artificial Sequence
  Synthetically generated peptide
PGTCEICYAACTGC

SEQ ID NO: 687 - protein, 13 aa, Artificial Sequence
  Synthetically generated peptide
PGTCEICAACTGC

SEQ ID NO: 688 - protein, 12 aa, Artificial Sequence
  Synthetically generated peptide
PGTCEICACTGC

SEQ ID NO: 689 - protein, 12 aa, Artificial Sequence
  Synthetically generated peptide
PGTCEICACTGC

SEQ ID NO: 690 - protein, 12 aa, Artificial Sequence
  Synthetically generated peptide
PGTCEICAACGC

SEQ ID NO: 691 - protein, 12 aa, Artificial Sequence
  Synthetically generated peptide
PGTCEICAACTC

SEQ ID NO: 692 - protein, 13 aa, Artificial Sequence
  Synthetically generated peptide
PGTCEICYACTGC

SEQ ID NO: 693 - protein, 12 aa, Artificial Sequence
  Synthetically generated peptide
PGTCEICYCTGC

SEQ ID NO: 694 - protein, 12 aa, Artificial Sequence
  Synthetically generated peptide
PGTCEICYACGC

SEQ ID NO: 695 - protein, 12 aa, Artificial Sequence
  Synthetically generated peptide
PGTCEICYACTC

SEQ ID NO: 696 - protein, 13 aa, Artificial Sequence
  Synthetically generated peptide
PGTCEICYACTGC

SEQ ID NO: 697 - protein, 12 aa, Artificial Sequence
  Synthetically generated peptide
PGTCEICYACGC

SEQ ID NO: 698 - protein, 12 aa, Artificial Sequence
  Synthetically generated peptide
PGTCEICYACTC

SEQ ID NO: 699 - protein, 13 aa, Artificial Sequence
  Synthetically generated peptide
PGTCEICYAACGC

SEQ ID NO: 700 - protein, 12 aa, Artificial Sequence
  Synthetically generated peptide
PGTCEICYAACC

SEQ ID NO: 701 - protein, 13 aa, Artificial Sequence
  Synthetically generated peptide
PGTCEICYAACTC

SEQ ID NO: 702 - protein, 14 aa, Artificial Sequence
  Synthetically generated peptide
PGTCEICAAACTGC

SEQ ID NO: 703 - protein, 13 aa, Artificial Sequence
  Synthetically generated peptide
PGTCEICAACTGC

SEQ ID NO: 704 - protein, 12 aa, Artificial Sequence
  Synthetically generated peptide
PGTCEICACTGC

SEQ ID NO: 705 - protein, 12 aa, Artificial Sequence
  Synthetically generated peptide
PGTCEICAACGC

SEQ ID NO: 706 - protein, 12 aa, Artificial Sequence
  Synthetically generated peptide
PGTCEICAACTC

SEQ ID NO: 707 - protein, 13 aa, Artificial Sequence
  Synthetically generated peptide
PGTCEICAACTGC

SEQ ID NO: 708 - protein, 12 aa, Artificial Sequence
  Synthetically generated peptide
PGTCEICAACGC

SEQ ID NO: 709 - protein, 12 aa, Artificial Sequence
  Synthetically generated peptide
PGTCEICAACTC

SEQ ID NO: 710 - protein, 13 aa, Artificial Sequence
  Synthetically generated peptide
PGTCEICAAACGC

SEQ ID NO: 711 - protein, 12 aa, Artificial Sequence
  Synthetically generated peptide
PGTCEICAAACC

SEQ ID NO: 712 - protein, 13 aa, Artificial Sequence
  Synthetically generated peptide
PGTCEICAAACTC

SEQ ID NO: 713 - protein, 14 aa, Artificial Sequence
  Synthetically generated peptide
PGTCEICAYACTGC

SEQ ID NO: 714 - protein, 13 aa, Artificial Sequence
  Synthetically generated peptide
PGTCEICAYCTGC

SEQ ID NO: 715 - protein, 12 aa, Artificial Sequence
  Synthetically generated peptide
PGTCEICAYCGC

SEQ ID NO: 716 - protein, 12 aa, Artificial Sequence
  Synthetically generated peptide
PGTCEICAYCTC

SEQ ID NO: 717 - protein, 13 aa, Artificial Sequence
  Synthetically generated peptide
PGTCEICAYACGC

SEQ ID NO: 718 - protein, 12 aa, Artificial Sequence
  Synthetically generated peptide
PGTCEICAYACC

SEQ ID NO: 719 - protein, 13 aa, Artificial Sequence
  Synthetically generated peptide
PGTCEICAYACTC

SEQ ID NO: 720 - protein, 14 aa, Artificial Sequence
  Synthetically generated peptide
PGTCEICAYACTGC

SEQ ID NO: 721 - protein, 13 aa, Artificial Sequence
  Synthetically generated peptide
PGTCEICAYACGC

SEQ ID NO: 722 - protein, 12 aa, Artificial Sequence
  Synthetically generated peptide
PGTCEICAYACC

SEQ ID NO: 723 - protein, 13 aa, Artificial Sequence
  Synthetically generated peptide
PGTCEICAYACTC

SEQ ID NO: 724 - protein, 14 aa, Artificial Sequence
  Synthetically generated peptide
PGTCEICAYAACGC

SEQ ID NO: 725 - protein, 13 aa, Artificial Sequence
  Synthetically generated peptide
PGTCEICAYAACC

SEQ ID NO: 726 - protein, 14 aa, Artificial Sequence
  Synthetically generated peptide
PGTCEICAYAACTC

SEQ ID NO: 727 - protein, 15 aa, Artificial Sequence [sequence omitted]

SEQ ID NO: 728 - protein, 14 aa, Artificial Sequence
  Synthetically generated peptide
PGTCGCAYAACTGC

SEQ ID NO: 729 - protein, 13 aa, Artificial Sequence
  Synthetically generated peptide
PGTCGCYAACTGC

SEQ ID NO: 730 - protein, 12 aa, Artificial Sequence
  Synthetically generated peptide
PGTCGCAACTGC

SEQ ID NO: 731 - protein, 12 aa, Artificial Sequence
  Synthetically generated peptide
PGTCGCYACTGC

SEQ ID NO: 732 - protein, 12 aa, Artificial Sequence
  Synthetically generated peptide
PGTCGCYACTGC

SEQ ID NO: 733 - protein, 12 aa, Artificial Sequence
  Synthetically generated peptide
PGTCGCYAACGC

SEQ ID NO: 734 - protein, 12 aa, Artificial Sequence
  Synthetically generated peptide
PGTCGCYAACTC

SEQ ID NO: 735 - protein, 13 aa, Artificial Sequence
  Synthetically generated peptide
PGTCGCAAACTGC

SEQ ID NO: 736 - protein, 12 aa, Artificial Sequence
  Synthetically generated peptide
PGTCGCAACTGC

SEQ ID NO: 737 - protein, 12 aa, Artificial Sequence
  Synthetically generated peptide
PGTCGCAACTGC

SEQ ID NO: 738 - protein, 12 aa, Artificial Sequence
  Synthetically generated peptide
PGTCGCAAACGC

SEQ ID NO: 739 - protein, 12 aa, Artificial Sequence
  Synthetically generated peptide
PGTCGCAAACTC

SEQ ID NO: 740 - protein, 13 aa, Artificial Sequence
  Synthetically generated peptide
PGTCGCAYACTGC

SEQ ID NO: 741 - protein, 12 aa, Artificial Sequence
  Synthetically generated peptide
PGTCGCAYCTGC

SEQ ID NO: 742 - protein, 12 aa, Artificial Sequence
  Synthetically generated peptide
PGTCGCAYACGC

SEQ ID NO: 743 - protein, 12 aa, Artificial Sequence
  Synthetically generated peptide
PGTCGCAYACTC

SEQ ID NO: 744 - protein, 13 aa, Artificial Sequence
  Synthetically generated peptide
PGTCGCAYACTGC

SEQ ID NO: 745 - protein, 12 aa, Artificial Sequence
  Synthetically generated peptide
PGTCGCAYACGC

SEQ ID NO: 746 - protein, 12 aa, Artificial Sequence
  Synthetically generated peptide
PGTCGCAYACTC

SEQ ID NO: 747 - protein, 13 aa, Artificial Sequence
  Synthetically generated peptide
PGTCGCAYAACGC

SEQ ID NO: 748 - protein, 12 aa, Artificial Sequence
  Synthetically generated peptide
PGTCGCAYAACC

SEQ ID NO: 749 - protein, 13 aa, Artificial Sequence
  Synthetically generated peptide
PGTCGCAYAACTC

SEQ ID NO: 750 - protein, 14 aa, Artificial Sequence
  Synthetically generated peptide
PGTCGICYAACTGC

SEQ ID NO: 751 - protein, 13 aa, Artificial Sequence
  Synthetically generated peptide
PGTCGICAACTGC

SEQ ID NO: 752 - protein, 12 aa, Artificial Sequence
  Synthetically generated peptide
PGTCGICACTGC

SEQ ID NO: 753 - protein, 12 aa, Artificial Sequence
  Synthetically generated peptide
PGTCGICACTGC

SEQ ID NO: 754 - protein, 12 aa, Artificial Sequence
  Synthetically generated peptide
PGTCGICAACGC

SEQ ID NO: 755 - protein, 12 aa, Artificial Sequence
  Synthetically generated peptide
PGTCGICAACTC

SEQ ID NO: 756 - protein, 13 aa, Artificial Sequence
  Synthetically generated peptide
PGTCGICYACTGC

SEQ ID NO: 757 - protein, 12 aa, Artificial Sequence
  Synthetically generated peptide
PGTCGICYCTGC

SEQ ID NO: 758 - protein, 12 aa, Artificial Sequence
  Synthetically generated peptide
PGTCGICYACGC

SEQ ID NO: 759 - protein, 12 aa, Artificial Sequence
  Synthetically generated peptide
PGTCGICYACTC

SEQ ID NO: 760 - protein, 13 aa, Artificial Sequence
  Synthetically generated peptide
PGTCGICYACTGC

SEQ ID NO: 761 - protein, 12 aa, Artificial Sequence
  Synthetically generated peptide
PGTCGICYACGC

SEQ ID NO: 762 - protein, 12 aa, Artificial Sequence
  Synthetically generated peptide
PGTCGICYACTC

SEQ ID NO: 763 - protein, 13 aa, Artificial Sequence
  Synthetically generated peptide
PGTCGICYAACGC

SEQ ID NO: 764 - protein, 12 aa, Artificial Sequence
  Synthetically generated peptide
PGTCGICYAACC

SEQ ID NO: 765 - protein, 13 aa, Artificial Sequence
  Synthetically generated peptide
PGTCGICYAACTC

SEQ ID NO: 766 - protein, 14 aa, Artificial Sequence
  Synthetically generated peptide
PGTCGICAAACTGC

SEQ ID NO: 767 - protein, 13 aa, Artificial Sequence
  Synthetically generated peptide
PGTCGICAACTGC

SEQ ID NO: 768 - protein, 12 aa, Artificial Sequence
  Synthetically generated peptide
PGTCGICACTGC

SEQ ID NO: 769 - protein, 12 aa, Artificial Sequence
  Synthetically generated peptide
PGTCGICAACGC

SEQ ID NO: 770 - protein, 12 aa, Artificial Sequence
  Synthetically generated peptide
PGTCGICAACTC

SEQ ID NO: 771 - protein, 13 aa, Artificial Sequence
  Synthetically generated peptide
PGTCGICAACTGC

SEQ ID NO: 772 - protein, 12 aa, Artificial Sequence
  Synthetically generated peptide
PGTCGICAACGC

SEQ ID NO: 773 - protein, 12 aa, Artificial Sequence
  Synthetically generated peptide
PGTCGICAACTC

SEQ ID NO: 774 - protein, 13 aa, Artificial Sequence
  Synthetically generated peptide
PGTCGICAAACGC

SEQ ID NO: 775 - protein, 12 aa, Artificial Sequence
  Synthetically generated peptide
PGTCGICAAACC

SEQ ID NO: 776 - protein, 13 aa, Artificial Sequence
  Synthetically generated peptide
PGTCGICAAACTC

SEQ ID NO: 777 - protein, 14 aa, Artificial Sequence
  Synthetically generated peptide
PGTCGICAYACTGC

SEQ ID NO: 778 - protein, 13 aa, Artificial Sequence
  Synthetically generated peptide
PGTCGICAYCTGC

SEQ ID NO: 779 - protein, 12 aa, Artificial Sequence
  Synthetically generated peptide
PGTCGICAYCGC

SEQ ID NO: 780 - protein, 12 aa, Artificial Sequence
  Synthetically generated peptide
PGTCGICAYCTC

SEQ ID NO: 781 - protein, 13 aa, Artificial Sequence
  Synthetically generated peptide
PGTCGICAYACGC

SEQ ID NO: 782 - protein, 12 aa, Artificial Sequence
  Synthetically generated peptide
PGTCGICAYACC

SEQ ID NO: 783 - protein, 13 aa, Artificial Sequence
  Synthetically generated peptide
PGTCGICAYACTC

SEQ ID NO: 784 - protein, 14 aa, Artificial Sequence
  Synthetically generated peptide
PGTCGICAYACTGC

SEQ ID NO: 785 - protein, 13 aa, Artificial Sequence
  Synthetically generated peptide
PGTCGICAYACGC

SEQ ID NO: 786 - protein, 12 aa, Artificial Sequence
  Synthetically generated peptide
PGTCGICAYACC

SEQ ID NO: 787 - protein, 13 aa, Artificial Sequence
  Synthetically generated peptide
PGTCGICAYACTC

SEQ ID NO: 788 - protein, 14 aa, Artificial Sequence
  Synthetically generated peptide
PGTCGICAYAACGC

SEQ ID NO: 789 - protein, 13 aa, Artificial Sequence
  Synthetically generated peptide
PGTCGICAYAACC

SEQ ID NO: 790 - protein, 14 aa, Artificial Sequence
  Synthetically generated peptide
PGTCGICAYAACTC

SEQ ID NO: 791 - protein, 15 aa, Artificial Sequence
  Synthetically generated peptide
PGTCGECAYAACTGC

SEQ ID NO: 792 - protein, 14 aa, Artificial Sequence
  Synthetically generated peptide
PGTCGECYAACTGC

SEQ ID NO: 793 - protein, 13 aa, Artificial Sequence
  Synthetically generated peptide
PGTCGECAACTGC

SEQ ID NO: 794 - protein, 12 aa, Artificial Sequence
  Synthetically generated peptide
PGTCGECACTGC

SEQ ID NO: 795 - protein, 12 aa, Artificial Sequence
  Synthetically generated peptide
PGTCGECACTGC

SEQ ID NO: 796 - protein, 12 aa, Artificial Sequence
  Synthetically generated peptide
PGTCGECAACGC

SEQ ID NO: 797 - protein, 12 aa, Artificial Sequence
  Synthetically generated peptide
PGTCGECAACTC

SEQ ID NO: 798 - protein, 13 aa, Artificial Sequence
  Synthetically generated peptide
PGTCGECYACTGC

SEQ ID NO: 799 - protein, 12 aa, Artificial Sequence
  Synthetically generated peptide
PGTCGECYCTGC

SEQ ID NO: 800 - protein, 12 aa, Artificial Sequence
  Synthetically generated peptide
PGTCGECYACGC

SEQ ID NO: 801 - protein, 12 aa, Artificial Sequence
  Synthetically generated peptide
PGTCGECYACTC

SEQ ID NO: 802 - protein, 13 aa, Artificial Sequence
  Synthetically generated peptide
PGTCGECYACTGC

SEQ ID NO: 803 - protein, 12 aa, Artificial Sequence
  Synthetically generated peptide
PGTCGECYACGC

SEQ ID NO: 804 - protein, 12 aa, Artificial Sequence
  Synthetically generated peptide
PGTCGECYACTC

SEQ ID NO: 805 - protein, 13 aa, Artificial Sequence
  Synthetically generated peptide
PGTCGECYAACGC

SEQ ID NO: 806 - protein, 12 aa, Artificial Sequence
  Synthetically generated peptide
PGTCGECYAACC

SEQ ID NO: 807 - protein, 13 aa, Artificial Sequence
  Synthetically generated peptide
PGTCGECYAACTC

SEQ ID NO: 808 - protein, 14 aa, Artificial Sequence
  Synthetically generated peptide
PGTCGECAAACTGC

SEQ ID NO: 809 - protein, 13 aa, Artificial Sequence
  Synthetically generated peptide
PGTCGECAACTGC

SEQ ID NO: 810 - protein, 12 aa, Artificial Sequence
  Synthetically generated peptide
PGTCGECACTGC

SEQ ID NO: 811 - protein, 12 aa, Artificial Sequence
  Synthetically generated peptide
PGTCGECAACGC

SEQ ID NO: 812 - protein, 12 aa, Artificial Sequence
  Synthetically generated peptide
PGTCGECAACTC

SEQ ID NO: 813 - protein, 13 aa, Artificial Sequence
  Synthetically generated peptide
PGTCGECAACTGC

SEQ ID NO: 814 - protein, 12 aa, Artificial Sequence
  Synthetically generated peptide
PGTCGECAACGC

SEQ ID NO: 815 - protein, 12 aa, Artificial Sequence
  Synthetically generated peptide
PGTCGECAACTC

SEQ ID NO: 816 - protein, 13 aa, Artificial Sequence
  Synthetically generated peptide
PGTCGECAAACGC

SEQ ID NO: 817 - protein, 12 aa, Artificial Sequence
  Synthetically generated peptide
PGTCGECAAACC

SEQ ID NO: 818 - protein, 13 aa, Artificial Sequence
  Synthetically generated peptide
PGTCGECAAACTC

SEQ ID NO: 819 - protein, 14 aa, Artificial Sequence
  Synthetically generated peptide
PGTCGECAYACTGC

SEQ ID NO: 820 - protein, 13 aa, Artificial Sequence
  Synthetically generated peptide
PGTCGECAYCTGC

SEQ ID NO: 821 - protein, 12 aa, Artificial Sequence
  Synthetically generated peptide
PGTCGECAYCGC

SEQ ID NO: 822 - protein, 12 aa, Artificial Sequence
  Synthetically generated peptide
PGTCGECAYCTC

SEQ ID NO: 823 - protein, 13 aa, Artificial Sequence
  Synthetically generated peptide
PGTCGECAYACGC

SEQ ID NO: 824 - protein, 12 aa, Artificial Sequence
  Synthetically generated peptide
PGTCGECAYACC

SEQ ID NO: 825 - protein, 13 aa, Artificial Sequence
  Synthetically generated peptide
PGTCGECAYACTC

SEQ ID NO: 826 - protein, 14 aa, Artificial Sequence
  Synthetically generated peptide
PGTCGECAYACTGC

SEQ ID NO: 827 - protein, 13 aa, Artificial Sequence
  Synthetically generated peptide
PGTCGECAYACGC

SEQ ID NO: 828 - protein, 12 aa, Artificial Sequence
  Synthetically generated peptide
PGTCGECAYACC

SEQ ID NO: 829 - protein, 13 aa, Artificial Sequence
  Synthetically generated peptide
PGTCGECAYACTC

SEQ ID NO: 830 - protein, 14 aa, Artificial Sequence
  Synthetically generated peptide
PGTCGECAYAACGC

SEQ ID NO: 831 - protein, 13 aa, Artificial Sequence
  Synthetically generated peptide
PGTCGECAYAACC

SEQ ID NO: 832 - protein, 14 aa, Artificial Sequence
  Synthetically generated peptide
PGTCGECAYAACTC

SEQ ID NO: 833 - protein, 15 aa, Artificial Sequence
  Synthetically generated peptide
PGTCGEICYAACTGC

SEQ ID NO: 834 - protein, 14 aa, Artificial Sequence
  Synthetically generated peptide
PGTCGEICAACTGC

SEQ ID NO: 835 - protein, 13 aa, Artificial Sequence
  Synthetically generated peptide
PGTCGEICACTGC

SEQ ID NO: 836 - protein, 12 aa, Artificial Sequence
  Synthetically generated peptide
PGTCGEICCTGC

SEQ ID NO: 837 - protein, 12 aa, Artificial Sequence
  Synthetically generated peptide
PGTCGEICACGC

SEQ ID NO: 838 - protein, 12 aa, Artificial Sequence
  Synthetically generated peptide
PGTCGEICACTC

SEQ ID NO: 839 - protein, 13 aa, Artificial Sequence
  Synthetically generated peptide
PGTCGEICACTGC

SEQ ID NO: 840 - protein, 12 aa, Artificial Sequence
  Synthetically generated peptide
PGTCGEICACGC

SEQ ID NO: 841 - protein, 12 aa, Artificial Sequence
  Synthetically generated peptide
PGTCGEICACTC

SEQ ID NO: 842 - protein, 13 aa, Artificial Sequence
  Synthetically generated peptide
PGTCGEICAACGC

SEQ ID NO: 843 - protein, 12 aa, Artificial Sequence
  Synthetically generated peptide
PGTCGEICAACC

SEQ ID NO: 844 - protein, 13 aa, Artificial Sequence
  Synthetically generated peptide
PGTCGEICAACTC

SEQ ID NO: 845 - protein, 14 aa, Artificial Sequence
  Synthetically generated peptide
PGTCGEICYACTGC

SEQ ID NO: 846 - protein, 13 aa, Artificial Sequence
  Synthetically generated peptide
PGTCGEICYCTGC

SEQ ID NO: 847 - protein, 12 aa, Artificial Sequence
  Synthetically generated peptide
PGTCGEICYCGC

SEQ ID NO: 848 - protein, 12 aa, Artificial Sequence
  Synthetically generated peptide
PGTCGEICYCTC

SEQ ID NO: 849 - protein, 13 aa, Artificial Sequence
  Synthetically generated peptide
PGTCGEICYACGC

SEQ ID NO: 850 - protein, 12 aa, Artificial Sequence
  Synthetically generated peptide
PGTCGEICYACC

SEQ ID NO: 851 - protein, 13 aa, Artificial Sequence
  Synthetically generated peptide
PGTCGEICYACTC

SEQ ID NO: 852 - protein, 14 aa, Artificial Sequence
  Synthetically generated peptide
PGTCGEICYACTGC

SEQ ID NO: 853 - protein, 13 aa, Artificial Sequence
  Synthetically generated peptide
PGTCGEICYACGC

SEQ ID NO: 854 - protein, 12 aa, Artificial Sequence
  Synthetically generated peptide
PGTCGEICYACC

SEQ ID NO: 855 - protein, 13 aa, Artificial Sequence
  Synthetically generated peptide
PGTCGEICYACTC

SEQ ID NO: 856 - protein, 14 aa, Artificial Sequence
  Synthetically generated peptide
PGTCGEICYAACGC

SEQ ID NO: 857 - protein, 13 aa, Artificial Sequence
  Synthetically generated peptide
PGTCGEICYAACC

SEQ ID NO: 858 - protein, 14 aa, Artificial Sequence
  Synthetically generated peptide
PGTCGEICYAACTC

SEQ ID NO: 859 - protein, 15 aa, Artificial Sequence
  Synthetically generated peptide
PGTCGEICAAACTGC

SEQ ID NO: 860 - protein, 14 aa, Artificial Sequence
  Synthetically generated peptide
PGTCGEICAACTGC

SEQ ID NO: 861 - protein, 13 aa, Artificial Sequence
  Synthetically generated peptide
PGTCGEICACTGC

SEQ ID NO: 862 - protein, 12 aa, Artificial Sequence
  Synthetically generated peptide
PGTCGEICACGC

SEQ ID NO: 863 - protein, 12 aa, Artificial Sequence
  Synthetically generated peptide
PGTCGEICACTC

SEQ ID NO: 864 - protein, 13 aa, Artificial Sequence
  Synthetically generated peptide
PGTCGEICAACGC

SEQ ID NO: 865 - protein, 12 aa, Artificial Sequence
  Synthetically generated peptide
PGTCGEICAACC

SEQ ID NO: 866 - protein, 13 aa, Artificial Sequence
  Synthetically generated peptide
PGTCGEICAACTC

SEQ ID NO: 867 - protein, 14 aa, Artificial Sequence
  Synthetically generated peptide
PGTCGEICAACTGC

SEQ ID NO: 868 - protein, 13 aa, Artificial Sequence
  Synthetically generated peptide
PGTCGEICAACGC

SEQ ID NO: 869 - protein, 12 aa, Artificial Sequence
  Synthetically generated peptide
PGTCGEICAACC

SEQ ID NO: 870 - protein, 13 aa, Artificial Sequence
  Synthetically generated peptide
PGTCGEICAACTC

SEQ ID NO: 871 - protein, 14 aa, Artificial Sequence
  Synthetically generated peptide
PGTCGEICAAACGC

SEQ ID NO: 872 - protein, 13 aa, Artificial Sequence
  Synthetically generated peptide
PGTCGEICAAACC

SEQ ID NO: 873 - protein, 14 aa, Artificial Sequence
  Synthetically generated peptide
PGTCGEICAAACTC

SEQ ID NO: 874 - protein, 15 aa, Artificial Sequence
  Synthetically generated peptide
PGTCGEICAYACTGC

SEQ ID NO: 875 - protein, 14 aa, Artificial Sequence
  Synthetically generated peptide
PGTCGEICAYCTGC

SEQ ID NO: 876 - protein, 13 aa, Artificial Sequence
  Synthetically generated peptide
PGTCGEICAYCGC

SEQ ID NO: 877 - protein, 12 aa, Artificial Sequence
  Synthetically generated peptide
PGTCGEICAYCC

SEQ ID NO: 878 - protein, 13 aa, Artificial Sequence
  Synthetically generated peptide
PGTCGEICAYCTC

SEQ ID NO: 879 - protein, 14 aa, Artificial Sequence
  Synthetically generated peptide
PGTCGEICAYACGC

SEQ ID NO: 880 - protein, 13 aa, Artificial Sequence
  Synthetically generated peptide
PGTCGEICAYACC

SEQ ID NO: 881 - protein, 14 aa, Artificial Sequence
  Synthetically generated peptide
PGTCGEICAYACTC

SEQ ID NO: 882 - protein, 15 aa, Artificial Sequence
  Synthetically generated peptide
PGTCGEICAYACTGC

SEQ ID NO: 883 - protein, 14 aa, Artificial Sequence
  Synthetically generated peptide
PGTCGEICAYACGC

SEQ ID NO: 884 - protein, 13 aa, Artificial Sequence
  Synthetically generated peptide
PGTCGEICAYACC

SEQ ID NO: 885 - protein, 14 aa, Artificial Sequence
  Synthetically generated peptide
PGTCGEICAYACTC

SEQ ID NO: 886 - protein, 15 aa, Artificial Sequence
  Synthetically generated peptide
PGTCGEICAYAACGC

SEQ ID NO: 887 - protein, 14 aa, Artificial Sequence
  Synthetically generated peptide
PGTCGEICAYAACC

SEQ ID NO: 888 - protein, 15 aa, Artificial Sequence
  Synthetically generated peptide
PGTCGEICAYAACTC

SEQ ID NO: 889 - protein, 17 aa, Artificial Sequence
  Synthetically generated peptide
  VARIANT (1)...(17): Xaa = Any Amino Acid
  VARIANT (1)...(17): Xaa = Any Amino Acid
PGXTCGEICAYAACTGC

SEQ ID NO: 890 - protein, 18 aa, Artificial Sequence
  Synthetically generated peptide
  VARIANT (1)...(18): Xaa = Any Amino Acid
  VARIANT (1)...(18): Xaa = Any Amino Acid
PGXXTCGEICAYAACTGC

SEQ ID NO: 891 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXXTCGEICAYAACTGC

SEQ ID NO: 892 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXXTCGEICAYAACTGC

SEQ ID NO: 893 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTXCGEICAYAACTGC

SEQ ID NO: 894 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTCXGEICAYAACTGC

SEQ ID NO: 895 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTCGXEICAYAACTGC

SEQ ID NO: 896 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTCGEXICAYAACTGC

SEQ ID NO: 897 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTCGEIXCAYAACTGC

SEQ ID NO: 898 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTCGEICXAYAACTGC

SEQ ID NO: 899 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTCGEICAXYAACTGC

SEQ ID NO: 900 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTCGEICAYXAACTGC

SEQ ID NO: 901 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTCGEICAYAXACTGC

SEQ ID NO: 902 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTCGEICAYAAXCTGC

SEQ ID NO: 903 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTCGEICAYAACXTGC

SEQ ID NO: 904 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTCGEICAYAACTXGC

SEQ ID NO: 905 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTCGEICAYAACTGXC

SEQ ID NO: 906 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXXTCGEICAYAACTGCX

SEQ ID NO: 907 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTXCGEICAYAACTGC

SEQ ID NO: 908 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXXCGEICAYAACTGC

SEQ ID NO: 909 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXCXGEICAYAACTGC

SEQ ID NO: 910 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXCGXEICAYAACTGC

SEQ ID NO: 911 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXCGEXICAYAACTGC

SEQ ID NO: 912 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXCGEIXCAYAACTGC

SEQ ID NO: 913 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXCGEICXAYAACTGC

SEQ ID NO: 914 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXCGEICAXYAACTGC

SEQ ID NO: 915 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXCGEICAYXAACTGC

SEQ ID NO: 916 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXCGEICAYAXACTGC

SEQ ID NO: 917 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXCGEICAYAAXCTGC

SEQ ID NO: 918 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXCGEICAYAACXTGC

SEQ ID NO: 919 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXCGEICAYAACTXGC

SEQ ID NO: 920 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXCGEICAYAACTGXC

SEQ ID NO: 921 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTXCGEICAYAACTGCX

SEQ ID NO: 922 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTCXGEICAYAACTGC

SEQ ID NO: 923 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCXXGEICAYAACTGC

SEQ ID NO: 924 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCXGXEICAYAACTGC

SEQ ID NO: 925 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCXGEXICAYAACTGC

SEQ ID NO: 926 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCXGEIXCAYAACTGC

SEQ ID NO: 927 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCXGEICXAYAACTGC

SEQ ID NO: 928 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCXGEICAXYAACTGC

SEQ ID NO: 929 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCXGEICAYXAACTGC

SEQ ID NO: 930 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCXGEICAYAXACTGC

SEQ ID NO: 931 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCXGEICAYAAXCTGC

SEQ ID NO: 932 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCXGEICAYAACXTGC

SEQ ID NO: 933 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCXGEICAYAACTXGC

SEQ ID NO: 934 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCXGEICAYAACTGXC

SEQ ID NO: 935 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCXGEICAYAACTGCX

SEQ ID NO: 936 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTCGXEICAYAACTGC

SEQ ID NO: 937 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGXXEICAYAACTGC

SEQ ID NO: 938 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGXEXICAYAACTGC

SEQ ID NO: 939 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGXEIXCAYAACTGC

SEQ ID NO: 940 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGXEICXAYAACTGC

SEQ ID NO: 941 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGXEICAXYAACTGC

SEQ ID NO: 942 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGXEICAYXAACTGC

SEQ ID NO: 943 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGXEICAYAXACTGC

SEQ ID NO: 944 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGXEICAYAAXCTGC

SEQ ID NO: 945 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGXEICAYAACXTGC

SEQ ID NO: 946 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGXEICAYAACTXGC

SEQ ID NO: 947 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGXEICAYAACTGXC

SEQ ID NO: 948 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGXEICAYAACTGCX

SEQ ID NO: 949 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTCGEXICAYAACTGC

SEQ ID NO: 950 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEXXICAYAACTGC

SEQ ID NO: 951 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEXIXCAYAACTGC

SEQ ID NO: 952 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEXICXAYAACTGC

SEQ ID NO: 953 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEXICAXYAACTGC

SEQ ID NO: 954 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEXICAYXAACTGC

SEQ ID NO: 955 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEXICAYAXACTGC

SEQ ID NO: 956 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEXICAYAAXCTGC

SEQ ID NO: 957 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEXICAYAACXTGC

SEQ ID NO: 958 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEXICAYAACTXGC

SEQ ID NO: 959 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEXICAYAACTGXC

SEQ ID NO: 960 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEXICAYAACTGCX

SEQ ID NO: 961 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTCGEIXCAYAACTGC

SEQ ID NO: 962 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEIXXCAYAACTGC

SEQ ID NO: 963 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEIXCXAYAACTGC

SEQ ID NO: 964 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEIXCAXYAACTGC

SEQ ID NO: 965 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEIXCAYXAACTGC

SEQ ID NO: 966 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEIXCAYAXACTGC

SEQ ID NO: 967 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEIXCAYAAXCTGC

SEQ ID NO: 968 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEIXCAYAACXTGC

SEQ ID NO: 969 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEIXCAYAACTXGC

SEQ ID NO: 970 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEIXCAYAACTGXC

SEQ ID NO: 971 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEIXCAYAACTGCX

SEQ ID NO: 972 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTCGEICXAYAACTGC

SEQ ID NO: 973 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICXXAYAACTGC

SEQ ID NO: 974 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICXAXYAACTGC

SEQ ID NO: 975 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICXAYXAACTGC

SEQ ID NO: 976 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICXAYAXACTGC

SEQ ID NO: 977 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICXAYAAXCTGC

SEQ ID NO: 978 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICXAYAACXTGC

SEQ ID NO: 979 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICXAYAACTXGC

SEQ ID NO: 980 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICXAYAACTGXC

SEQ ID NO: 981 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICXAYAACTGCX

SEQ ID NO: 982 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTCGEICAXYAACTGC

SEQ ID NO: 983 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAXXYAACTGC

SEQ ID NO: 984 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAXYXAACTGC

SEQ ID NO: 985 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAXYAXACTGC

SEQ ID NO: 986 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAXYAAXCTGC

SEQ ID NO: 987 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAXYAACXTGC

SEQ ID NO: 988 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAXYAACTXGC

SEQ ID NO: 989 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAXYAACTGXC

SEQ ID NO: 990 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAXYAACTGCX

SEQ ID NO: 991 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTCGEICAYXAACTGC

SEQ ID NO: 992 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYXXAACTGC

SEQ ID NO: 993 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYXAXACTGC

SEQ ID NO: 994 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYXAAXCTGC

SEQ ID NO: 995 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYXAACXTGC

SEQ ID NO: 996 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYXAACTXGC

SEQ ID NO: 997 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYXAACTGXC

SEQ ID NO: 998 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYXAACTGCX

SEQ ID NO: 999 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTCGEICAYAXACTGC

SEQ ID NO: 1000 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAXXACTGC

SEQ ID NO: 1001 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAXAXCTGC

SEQ ID NO: 1002 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAXACXTGC

SEQ ID NO: 1003 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAXACTXGC

SEQ ID NO: 1004 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAXACTGXC

SEQ ID NO: 1005 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAXACTGCX

SEQ ID NO: 1006 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTCGEICAYAAXCTGC

SEQ ID NO: 1007 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAAXXCTGC

SEQ ID NO: 1008 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAAXCXTGC

SEQ ID NO: 1009 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAAXCTXGC

SEQ ID NO: 1010 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAAXCTGXC

SEQ ID NO: 1011 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAAXCTGCX

SEQ ID NO: 1012 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTCGEICAYAACXTGC

SEQ ID NO: 1013 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAACXXTGC

SEQ ID NO: 1014 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAACXTXGC

SEQ ID NO: 1015 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAACXTGXC

SEQ ID NO: 1016 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAACXTGCX

SEQ ID NO: 1017 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTCGEICAYAACTXGC

SEQ ID NO: 1018 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAACTXXGC

SEQ ID NO: 1019 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAACTXGXC

SEQ ID NO: 1020 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAACTXGCX

SEQ ID NO: 1021 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTCGEICAYAACTGXC

SEQ ID NO: 1022 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAACTGXXC

SEQ ID NO: 1023 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAACTGXCX

SEQ ID NO: 1024 - protein, 19 aa, Artificial Sequence
  Synthetically generated peptide
  VARIANT (1)...(19): Xaa = Any Amino Acid
  VARIANT (1)...(19): Xaa = Any Amino Acid
PGXXTCGEICAYAACTGCX

SEQ ID NO: 1025 - protein, 20 aa, Artificial Sequence
  Synthetically generated peptide
  VARIANT (1)...(20): Xaa = Any Amino Acid
  VARIANT (1)...(20): Xaa = Any Amino Acid
PGXXTCGEICAYAACTGCXX

SEQ ID NO: 1026 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTXCGEICAYAACTGC

SEQ ID NO: 1027 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXXCGEICAYAACTGC

SEQ ID NO: 1028 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXXCGEICAYAACTGC

SEQ ID NO: 1029 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXCXGEICAYAACTGC

SEQ ID NO: 1030 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXCGXEICAYAACTGC

SEQ ID NO: 1031 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXCGEXICAYAACTGC

SEQ ID NO: 1032 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXCGEIXCAYAACTGC

SEQ ID NO: 1033 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXCGEICXAYAACTGC

SEQ ID NO: 1034 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXCGEICAXYAACTGC

SEQ ID NO: 1035 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXCGEICAYXAACTGC

SEQ ID NO: 1036 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXCGEICAYAXACTGC

SEQ ID NO: 1037 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXCGEICAYAAXCTGC

SEQ ID NO: 1038 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXCGEICAYAACXTGC

SEQ ID NO: 1039 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXCGEICAYAACTXGC

SEQ ID NO: 1040 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXCGEICAYAACTGXC

SEQ ID NO: 1041 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXXCGEICAYAACTGCX

SEQ ID NO: 1042 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXCXGEICAYAACTGC

SEQ ID NO: 1043 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCXXGEICAYAACTGC

SEQ ID NO: 1044 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCXGXEICAYAACTGC

SEQ ID NO: 1045 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCXGEXICAYAACTGC

SEQ ID NO: 1046 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCXGEIXCAYAACTGC

SEQ ID NO: 1047 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCXGEICXAYAACTGC

SEQ ID NO: 1048 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCXGEICAXYAACTGC

SEQ ID NO: 1049 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCXGEICAYXAACTGC

SEQ ID NO: 1050 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCXGEICAYAXACTGC

SEQ ID NO: 1051 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCXGEICAYAAXCTGC

SEQ ID NO: 1052 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCXGEICAYAACXTGC

SEQ ID NO: 1053 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCXGEICAYAACTXGC

SEQ ID NO: 1054 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCXGEICAYAACTGXC

SEQ ID NO: 1055 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCXGEICAYAACTGCX

SEQ ID NO: 1056 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXCGXEICAYAACTGC

SEQ ID NO: 1057 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGXXEICAYAACTGC

SEQ ID NO: 1058 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGXEXICAYAACTGC

SEQ ID NO: 1059 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGXEIXCAYAACTGC

SEQ ID NO: 1060 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGXEICXAYAACTGC

SEQ ID NO: 1061 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGXEICAXYAACTGC

SEQ ID NO: 1062 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGXEICAYXAACTGC

SEQ ID NO: 1063 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGXEICAYAXACTGC

SEQ ID NO: 1064 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGXEICAYAAXCTGC

SEQ ID NO: 1065 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGXEICAYAACXTGC

SEQ ID NO: 1066 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGXEICAYAACTXGC

SEQ ID NO: 1067 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGXEICAYAACTGXC

SEQ ID NO: 1068 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGXEICAYAACTGCX

SEQ ID NO: 1069 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXCGEXICAYAACTGC

SEQ ID NO: 1070 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEXXICAYAACTGC

SEQ ID NO: 1071 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEXIXCAYAACTGC

SEQ ID NO: 1072 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEXICXAYAACTGC

SEQ ID NO: 1073 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEXICAXYAACTGC

SEQ ID NO: 1074 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEXICAYXAACTGC

SEQ ID NO: 1075 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEXICAYAXACTGC

SEQ ID NO: 1076 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEXICAYAAXCTGC

SEQ ID NO: 1077 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEXICAYAACXTGC

SEQ ID NO: 1078 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEXICAYAACTXGC

SEQ ID NO: 1079 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEXICAYAACTGXC

SEQ ID NO: 1080 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEXICAYAACTGCX

SEQ ID NO: 1081 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXCGEIXCAYAACTGC

SEQ ID NO: 1082 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEIXXCAYAACTGC

SEQ ID NO: 1083 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEIXCXAYAACTGC

SEQ ID NO: 1084 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEIXCAXYAACTGC

SEQ ID NO: 1085 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEIXCAYXAACTGC

SEQ ID NO: 1086 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEIXCAYAXACTGC

SEQ ID NO: 1087 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEIXCAYAAXCTGC

SEQ ID NO: 1088 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEIXCAYAACXTGC

SEQ ID NO: 1089 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEIXCAYAACTXGC

SEQ ID NO: 1090 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEIXCAYAACTGXC

SEQ ID NO: 1091 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEIXCAYAACTGCX

SEQ ID NO: 1092 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXCGEICXAYAACTGC

SEQ ID NO: 1093 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICXXAYAACTGC

SEQ ID NO: 1094 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICXAXYAACTGC

SEQ ID NO: 1095 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICXAYXAACTGC

SEQ ID NO: 1096 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICXAYAXACTGC

SEQ ID NO: 1097 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICXAYAAXCTGC

SEQ ID NO: 1098 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICXAYAACXTGC

SEQ ID NO: 1099 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICXAYAACTXGC

SEQ ID NO: 1100 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICXAYAACTGXC

SEQ ID NO: 1101 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICXAYAACTGCX

SEQ ID NO: 1102 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXCGEICAXYAACTGC

SEQ ID NO: 1103 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAXXYAACTGC

SEQ ID NO: 1104 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAXYXAACTGC

SEQ ID NO: 1105 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAXYAXACTGC

SEQ ID NO: 1106 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAXYAAXCTGC

SEQ ID NO: 1107 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAXYAACXTGC

SEQ ID NO: 1108 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAXYAACTXGC

SEQ ID NO: 1109 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAXYAACTGXC

SEQ ID NO: 1110 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAXYAACTGCX

SEQ ID NO: 1111 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXCGEICAYXAACTGC

SEQ ID NO: 1112 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYXXAACTGC

SEQ ID NO: 1113 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYXAXACTGC

SEQ ID NO: 1114 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYXAAXCTGC

SEQ ID NO: 1115 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYXAACXTGC

SEQ ID NO: 1116 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYXAACTXGC

SEQ ID NO: 1117 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYXAACTGXC

SEQ ID NO: 1118 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYXAACTGCX

SEQ ID NO: 1119 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXCGEICAYAXACTGC

SEQ ID NO: 1120 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAXXACTGC

SEQ ID NO: 1121 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAXAXCTGC

SEQ ID NO: 1122 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAXACXTGC

SEQ ID NO: 1123 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAXACTXGC

SEQ ID NO: 1124 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAXACTGXC

SEQ ID NO: 1125 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAXACTGCX

SEQ ID NO: 1126 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXCGEICAYAAXCTGC

SEQ ID NO: 1127 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAAXXCTGC

SEQ ID NO: 1128 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAAXCXTGC

SEQ ID NO: 1129 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAAXCTXGC

SEQ ID NO: 1130 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAAXCTGXC

SEQ ID NO: 1131 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAAXCTGCX

SEQ ID NO: 1132 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXCGEICAYAACXTGC

SEQ ID NO: 1133 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAACXXTGC

SEQ ID NO: 1134 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAACXTXGC

SEQ ID NO: 1135 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAACXTGXC

SEQ ID NO: 1136 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAACXTGCX

SEQ ID NO: 1137 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXCGEICAYAACTXGC

SEQ ID NO: 1138 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAACTXXGC

SEQ ID NO: 1139 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAACTXGXC

SEQ ID NO: 1140 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAACTXGCX

SEQ ID NO: 1141 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXCGEICAYAACTGXC

SEQ ID NO: 1142 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAACTGXXC

SEQ ID NO: 1143 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAACTGXCX

SEQ ID NO: 1144 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTXCGEICAYAACTGCX

SEQ ID NO: 1145 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTXCGEICAYAACTGCXX

SEQ ID NO: 1146 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTCXGEICAYAACTGC

SEQ ID NO: 1147 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCXXGEICAYAACTGC

SEQ ID NO: 1148 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXXXGEICAYAACTGC

SEQ ID NO: 1149 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXXGXEICAYAACTGC

SEQ ID NO: 1150 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXXGEXICAYAACTGC

SEQ ID NO: 1151 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXXGEIXCAYAACTGC

SEQ ID NO: 1152 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXXGEICXAYAACTGC

SEQ ID NO: 1153 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXXGEICAXYAACTGC

SEQ ID NO: 1154 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXXGEICAYXAACTGC

SEQ ID NO: 1155 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXXGEICAYAXACTGC

SEQ ID NO: 1156 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXXGEICAYAAXCTGC

SEQ ID NO: 1157 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXXGEICAYAACXTGC

SEQ ID NO: 1158 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXXGEICAYAACTXGC

SEQ ID NO: 1159 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXXGEICAYAACTGXC

SEQ ID NO: 1160 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXXGEICAYAACTGCX

SEQ ID NO: 1161 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCXGXEICAYAACTGC

SEQ ID NO: 1162 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGXXEICAYAACTGC

SEQ ID NO: 1163 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGXEXICAYAACTGC

SEQ ID NO: 1164 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGXEIXCAYAACTGC

SEQ ID NO: 1165 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGXEICXAYAACTGC

SEQ ID NO: 1166 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGXEICAXYAACTGC

SEQ ID NO: 1167 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGXEICAYXAACTGC

SEQ ID NO: 1168 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGXEICAYAXACTGC

SEQ ID NO: 1169 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGXEICAYAAXCTGC

SEQ ID NO: 1170 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGXEICAYAACXTGC

SEQ ID NO: 1171 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGXEICAYAACTXGC

SEQ ID NO: 1172 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGXEICAYAACTGXC

SEQ ID NO: 1173 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGXEICAYAACTGCX

SEQ ID NO: 1174 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCXGEXICAYAACTGC

SEQ ID NO: 1175 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEXXICAYAACTGC

SEQ ID NO: 1176 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEXIXCAYAACTGC

SEQ ID NO: 1177 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEXICXAYAACTGC

SEQ ID NO: 1178 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEXICAXYAACTGC

SEQ ID NO: 1179 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEXICAYXAACTGC

SEQ ID NO: 1180 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEXICAYAXACTGC

SEQ ID NO: 1181 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEXICAYAAXCTGC

SEQ ID NO: 1182 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEXICAYAACXTGC

SEQ ID NO: 1183 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEXICAYAACTXGC

SEQ ID NO: 1184 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEXICAYAACTGXC

SEQ ID NO: 1185 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEXICAYAACTGCX

SEQ ID NO: 1186 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCXGEIXCAYAACTGC

SEQ ID NO: 1187 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEIXXCAYAACTGC

SEQ ID NO: 1188 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEIXCXAYAACTGC

SEQ ID NO: 1189 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEIXCAXYAACTGC

SEQ ID NO: 1190 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEIXCAYXAACTGC

SEQ ID NO: 1191 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEIXCAYAXACTGC

SEQ ID NO: 1192 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEIXCAYAAXCTGC

SEQ ID NO: 1193 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEIXCAYAACXTGC

SEQ ID NO: 1194 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEIXCAYAACTXGC

SEQ ID NO: 1195 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEIXCAYAACTGXC

SEQ ID NO: 1196 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEIXCAYAACTGCX

SEQ ID NO: 1197 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCXGEICXAYAACTGC

SEQ ID NO: 1198 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICXXAYAACTGC

SEQ ID NO: 1199 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICXAXYAACTGC

SEQ ID NO: 1200 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICXAYXAACTGC

SEQ ID NO: 1201 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICXAYAXACTGC

SEQ ID NO: 1202 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICXAYAAXCTGC

SEQ ID NO: 1203 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICXAYAACXTGC

SEQ ID NO: 1204 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICXAYAACTXGC

SEQ ID NO: 1205 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICXAYAACTGXC

SEQ ID NO: 1206 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICXAYAACTGCX

SEQ ID NO: 1207 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCXGEICAXYAACTGC

SEQ ID NO: 1208 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAXXYAACTGC

SEQ ID NO: 1209 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAXYXAACTGC

SEQ ID NO: 1210 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAXYAXACTGC

SEQ ID NO: 1211 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAXYAAXCTGC

SEQ ID NO: 1212 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAXYAACXTGC

SEQ ID NO: 1213 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAXYAACTXGC

SEQ ID NO: 1214 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAXYAACTGXC

SEQ ID NO: 1215 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAXYAACTGCX

SEQ ID NO: 1216 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCXGEICAYXAACTGC

SEQ ID NO: 1217 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYXXAACTGC

SEQ ID NO: 1218 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYXAXACTGC

SEQ ID NO: 1219 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYXAAXCTGC

SEQ ID NO: 1220 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYXAACXTGC

SEQ ID NO: 1221 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYXAACTXGC

SEQ ID NO: 1222 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYXAACTGXC

SEQ ID NO: 1223 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYXAACTGCX

SEQ ID NO: 1224 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCXGEICAYAXACTGC

SEQ ID NO: 1225 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAXXACTGC

SEQ ID NO: 1226 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAXAXCTGC

SEQ ID NO: 1227 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAXACXTGC

SEQ ID NO: 1228 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAXACTXGC

SEQ ID NO: 1229 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAXACTGXC

SEQ ID NO: 1230 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAXACTGCX

SEQ ID NO: 1231 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCXGEICAYAAXCTGC

SEQ ID NO: 1232 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAAXXCTGC

SEQ ID NO: 1233 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAAXCXTGC

SEQ ID NO: 1234 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAAXCTXGC

SEQ ID NO: 1235 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAAXCTGXC

SEQ ID NO: 1236 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAAXCTGCX

SEQ ID NO: 1237 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCXGEICAYAACXTGC

SEQ ID NO: 1238 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAACXXTGC

SEQ ID NO: 1239 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAACXTXGC

SEQ ID NO: 1240 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAACXTGXC

SEQ ID NO: 1241 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAACXTGCX

SEQ ID NO: 1242 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCXGEICAYAACTXGC

SEQ ID NO: 1243 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAACTXXGC

SEQ ID NO: 1244 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAACTXGXC

SEQ ID NO: 1245 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAACTXGCX

SEQ ID NO: 1246 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCXGEICAYAACTGXC

SEQ ID NO: 1247 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAACTGXXC

SEQ ID NO: 1248 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAACTGXCX

SEQ ID NO: 1249 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCXGEICAYAACTGCX

SEQ ID NO: 1250 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCXGEICAYAACTGCXX

SEQ ID NO: 1251 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTCGXEICAYAACTGC

SEQ ID NO: 1252 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGXXEICAYAACTGC

SEQ ID NO: 1253 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXXXEICAYAACTGC

SEQ ID NO: 1254 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXXEXICAYAACTGC

SEQ ID NO: 1255 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXXEIXCAYAACTGC

SEQ ID NO: 1256 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXXEICXAYAACTGC

SEQ ID NO: 1257 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXXEICAXYAACTGC

SEQ ID NO: 1258 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXXEICAYXAACTGC

SEQ ID NO: 1259 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXXEICAYAXACTGC

SEQ ID NO: 1260 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXXEICAYAAXCTGC

SEQ ID NO: 1261 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXXEICAYAACXTGC

SEQ ID NO: 1262 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXXEICAYAACTXGC

SEQ ID NO: 1263 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXXEICAYAACTGXC

SEQ ID NO: 1264 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXXEICAYAACTGCX

SEQ ID NO: 1265 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGXEXICAYAACTGC

SEQ ID NO: 1266 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEXXICAYAACTGC

SEQ ID NO: 1267 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEXIXCAYAACTGC

SEQ ID NO: 1268 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEXICXAYAACTGC

SEQ ID NO: 1269 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEXICAXYAACTGC

SEQ ID NO: 1270 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEXICAYXAACTGC

SEQ ID NO: 1271 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEXICAYAXACTGC

SEQ ID NO: 1272 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEXICAYAAXCTGC

SEQ ID NO: 1273 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEXICAYAACXTGC

SEQ ID NO: 1274 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEXICAYAACTXGC

SEQ ID NO: 1275 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEXICAYAACTGXC

SEQ ID NO: 1276 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEXICAYAACTGCX

SEQ ID NO: 1277 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGXEIXCAYAACTGC

SEQ ID NO: 1278 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEIXXCAYAACTGC

SEQ ID NO: 1279 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEIXCXAYAACTGC

SEQ ID NO: 1280 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEIXCAXYAACTGC

SEQ ID NO: 1281 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEIXCAYXAACTGC

SEQ ID NO: 1282 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEIXCAYAXACTGC

SEQ ID NO: 1283 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEIXCAYAAXCTGC

SEQ ID NO: 1284 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEIXCAYAACXTGC

SEQ ID NO: 1285 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEIXCAYAACTXGC

SEQ ID NO: 1286 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEIXCAYAACTGXC

SEQ ID NO: 1287 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEIXCAYAACTGCX

SEQ ID NO: 1288 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGXEICXAYAACTGC

SEQ ID NO: 1289 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICXXAYAACTGC

SEQ ID NO: 1290 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICXAXYAACTGC

SEQ ID NO: 1291 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICXAYXAACTGC

SEQ ID NO: 1292 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICXAYAXACTGC

SEQ ID NO: 1293 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICXAYAAXCTGC

SEQ ID NO: 1294 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICXAYAACXTGC

SEQ ID NO: 1295 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICXAYAACTXGC

SEQ ID NO: 1296 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICXAYAACTGXC

SEQ ID NO: 1297 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICXAYAACTGCX

SEQ ID NO: 1298 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGXEICAXYAACTGC

SEQ ID NO: 1299 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAXXYAACTGC

SEQ ID NO: 1300 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAXYXAACTGC

SEQ ID NO: 1301 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAXYAXACTGC

SEQ ID NO: 1302 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAXYAAXCTGC

SEQ ID NO: 1303 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAXYAACXTGC

SEQ ID NO: 1304 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAXYAACTXGC

SEQ ID NO: 1305 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAXYAACTGXC

SEQ ID NO: 1306 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAXYAACTGCX

SEQ ID NO: 1307 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGXEICAYXAACTGC

SEQ ID NO: 1308 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYXXAACTGC

SEQ ID NO: 1309 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYXAXACTGC

SEQ ID NO: 1310 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYXAAXCTGC

SEQ ID NO: 1311 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYXAACXTGC

SEQ ID NO: 1312 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYXAACTXGC

SEQ ID NO: 1313 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYXAACTGXC

SEQ ID NO: 1314 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYXAACTGCX

SEQ ID NO: 1315 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGXEICAYAXACTGC

SEQ ID NO: 1316 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAXXACTGC

SEQ ID NO: 1317 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAXAXCTGC

SEQ ID NO: 1318 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAXACXTGC

SEQ ID NO: 1319 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAXACTXGC

SEQ ID NO: 1320 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAXACTGXC

SEQ ID NO: 1321 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAXACTGCX

SEQ ID NO: 1322 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGXEICAYAAXCTGC

SEQ ID NO: 1323 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAAXXCTGC

SEQ ID NO: 1324 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAAXCXTGC

SEQ ID NO: 1325 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAAXCTXGC

SEQ ID NO: 1326 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAAXCTGXC

SEQ ID NO: 1327 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAAXCTGCX

SEQ ID NO: 1328 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGXEICAYAACXTGC

SEQ ID NO: 1329 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAACXXTGC

SEQ ID NO: 1330 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAACXTXGC

SEQ ID NO: 1331 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAACXTGXC

SEQ ID NO: 1332 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAACXTGCX

SEQ ID NO: 1333 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGXEICAYAACTXGC

SEQ ID NO: 1334 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAACTXXGC

SEQ ID NO: 1335 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAACTXGXC

SEQ ID NO: 1336 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAACTXGCX

SEQ ID NO: 1337 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGXEICAYAACTGXC

SEQ ID NO: 1338 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAACTGXXC

SEQ ID NO: 1339 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAACTGXCX

SEQ ID NO: 1340 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGXEICAYAACTGCX

SEQ ID NO: 1341 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGXEICAYAACTGCXX

SEQ ID NO: 1342 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTCGEXICAYAACTGC

SEQ ID NO: 1343 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEXXICAYAACTGC

SEQ ID NO: 1344 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXXXICAYAACTGC

SEQ ID NO: 1345 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXXIXCAYAACTGC

SEQ ID NO: 1346 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXXICXAYAACTGC

SEQ ID NO: 1347 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXXICAXYAACTGC

SEQ ID NO: 1348 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXXICAYXAACTGC

SEQ ID NO: 1349 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXXICAYAXACTGC

SEQ ID NO: 1350 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXXICAYAAXCTGC

SEQ ID NO: 1351 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXXICAYAACXTGC

SEQ ID NO: 1352 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXXICAYAACTXGC

SEQ ID NO: 1353 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXXICAYAACTGXC

SEQ ID NO: 1354 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXXICAYAACTGCX

SEQ ID NO: 1355 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEXIXCAYAACTGC

SEQ ID NO: 1356 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXIXXCAYAACTGC

SEQ ID NO: 1357 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXIXCXAYAACTGC

SEQ ID NO: 1358 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXIXCAXYAACTGC

SEQ ID NO: 1359 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXIXCAYXAACTGC

SEQ ID NO: 1360 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXIXCAYAXACTGC

SEQ ID NO: 1361 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXIXCAYAAXCTGC

SEQ ID NO: 1362 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXIXCAYAACXTGC

SEQ ID NO: 1363 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXIXCAYAACTXGC

SEQ ID NO: 1364 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXIXCAYAACTGXC

SEQ ID NO: 1365 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXIXCAYAACTGCX

SEQ ID NO: 1366 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEXICXAYAACTGC

SEQ ID NO: 1367 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICXXAYAACTGC

SEQ ID NO: 1368 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICXAXYAACTGC

SEQ ID NO: 1369 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICXAYXAACTGC

SEQ ID NO: 1370 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICXAYAXACTGC

SEQ ID NO: 1371 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICXAYAAXCTGC

SEQ ID NO: 1372 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICXAYAACXTGC

SEQ ID NO: 1373 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICXAYAACTXGC

SEQ ID NO: 1374 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICXAYAACTGXC

SEQ ID NO: 1375 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICXAYAACTGCX

SEQ ID NO: 1376 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEXICAXYAACTGC

SEQ ID NO: 1377 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAXXYAACTGC

SEQ ID NO: 1378 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAXYXAACTGC

SEQ ID NO: 1379 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAXYAXACTGC

SEQ ID NO: 1380 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAXYAAXCTGC

SEQ ID NO: 1381 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAXYAACXTGC

SEQ ID NO: 1382 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAXYAACTXGC

SEQ ID NO: 1383 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAXYAACTGXC

SEQ ID NO: 1384 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAXYAACTGCX

SEQ ID NO: 1385 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEXICAYXAACTGC

SEQ ID NO: 1386 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYXXAACTGC

SEQ ID NO: 1387 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYXAXACTGC

SEQ ID NO: 1388 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYXAAXCTGC

SEQ ID NO: 1389 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYXAACXTGC

SEQ ID NO: 1390 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYXAACTXGC

SEQ ID NO: 1391 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYXAACTGXC

SEQ ID NO: 1392 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYXAACTGCX

SEQ ID NO: 1393 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEXICAYAXACTGC

SEQ ID NO: 1394 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAXXACTGC

SEQ ID NO: 1395 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAXAXCTGC

SEQ ID NO: 1396 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAXACXTGC

SEQ ID NO: 1397 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAXACTXGC

SEQ ID NO: 1398 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAXACTGXC

SEQ ID NO: 1399 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAXACTGCX

SEQ ID NO: 1400 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEXICAYAAXCTGC

SEQ ID NO: 1401 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAAXXCTGC

SEQ ID NO: 1402 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAAXCXTGC

SEQ ID NO: 1403 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAAXCTXGC

SEQ ID NO: 1404 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAAXCTGXC

SEQ ID NO: 1405 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAAXCTGCX

SEQ ID NO: 1406 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEXICAYAACXTGC

SEQ ID NO: 1407 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAACXXTGC

SEQ ID NO: 1408 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAACXTXGC

SEQ ID NO: 1409 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAACXTGXC

SEQ ID NO: 1410 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAACXTGCX

SEQ ID NO: 1411 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEXICAYAACTXGC

SEQ ID NO: 1412 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAACTXXGC

SEQ ID NO: 1413 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAACTXGXC

SEQ ID NO: 1414 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAACTXGCX

SEQ ID NO: 1415 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEXICAYAACTGXC

SEQ ID NO: 1416 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAACTGXXC

SEQ ID NO: 1417 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAACTGXCX

SEQ ID NO: 1418 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEXICAYAACTGCX

SEQ ID NO: 1419 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEXICAYAACTGCXX

SEQ ID NO: 1420 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTCGEIXCAYAACTGC

SEQ ID NO: 1421 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEIXXCAYAACTGC

SEQ ID NO: 1422 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXXXCAYAACTGC

SEQ ID NO: 1423 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXXCXAYAACTGC

SEQ ID NO: 1424 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXXCAXYAACTGC

SEQ ID NO: 1425 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXXCAYXAACTGC

SEQ ID NO: 1426 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXXCAYAXACTGC

SEQ ID NO: 1427 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXXCAYAAXCTGC

SEQ ID NO: 1428 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXXCAYAACXTGC

SEQ ID NO: 1429 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXXCAYAACTXGC

SEQ ID NO: 1430 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXXCAYAACTGXC

SEQ ID NO: 1431 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXXCAYAACTGCX

SEQ ID NO: 1432 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEIXCXAYAACTGC

SEQ ID NO: 1433 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCXXAYAACTGC

SEQ ID NO: 1434 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCXAXYAACTGC

SEQ ID NO: 1435 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCXAYXAACTGC

SEQ ID NO: 1436 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCXAYAXACTGC

SEQ ID NO: 1437 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCXAYAAXCTGC

SEQ ID NO: 1438 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCXAYAACXTGC

SEQ ID NO: 1439 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCXAYAACTXGC

SEQ ID NO: 1440 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCXAYAACTGXC

SEQ ID NO: 1441 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCXAYAACTGCX

SEQ ID NO: 1442 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEIXCAXYAACTGC

SEQ ID NO: 1443 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAXXYAACTGC

SEQ ID NO: 1444 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAXYXAACTGC

SEQ ID NO: 1445 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAXYAXACTGC

SEQ ID NO: 1446 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAXYAAXCTGC

SEQ ID NO: 1447 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAXYAACXTGC

SEQ ID NO: 1448 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAXYAACTXGC

SEQ ID NO: 1449 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAXYAACTGXC

SEQ ID NO: 1450 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAXYAACTGCX

SEQ ID NO: 1451 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEIXCAYXAACTGC

SEQ ID NO: 1452 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYXXAACTGC

SEQ ID NO: 1453 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYXAXACTGC

SEQ ID NO: 1454 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYXAAXCTGC

SEQ ID NO: 1455 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYXAACXTGC

SEQ ID NO: 1456 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYXAACTXGC

SEQ ID NO: 1457 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYXAACTGXC

SEQ ID NO: 1458 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYXAACTGCX

SEQ ID NO: 1459 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEIXCAYAXACTGC

SEQ ID NO: 1460 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAXXACTGC

SEQ ID NO: 1461 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAXAXCTGC

SEQ ID NO: 1462 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAXACXTGC

SEQ ID NO: 1463 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAXACTXGC

SEQ ID NO: 1464 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAXACTGXC

SEQ ID NO: 1465 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAXACTGCX

SEQ ID NO: 1466 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEIXCAYAAXCTGC

SEQ ID NO: 1467 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAAXXCTGC

SEQ ID NO: 1468 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAAXCXTGC

SEQ ID NO: 1469 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAAXCTXGC

SEQ ID NO: 1470 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAAXCTGXC

SEQ ID NO: 1471 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAAXCTGCX

SEQ ID NO: 1472 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEIXCAYAACXTGC

SEQ ID NO: 1473 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAACXXTGC

SEQ ID NO: 1474 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAACXTXGC

SEQ ID NO: 1475 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAACXTGXC

SEQ ID NO: 1476 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAACXTGCX

SEQ ID NO: 1477 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEIXCAYAACTXGC

SEQ ID NO: 1478 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAACTXXGC

SEQ ID NO: 1479 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAACTXGXC

SEQ ID NO: 1480 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAACTXGCX

SEQ ID NO: 1481 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEIXCAYAACTGXC

SEQ ID NO: 1482 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAACTGXXC

SEQ ID NO: 1483 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAACTGXCX

SEQ ID NO: 1484 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEIXCAYAACTGCX

SEQ ID NO: 1485 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEIXCAYAACTGCXX

SEQ ID NO: 1486 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTCGEICXAYAACTGC

SEQ ID NO: 1487 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICXXAYAACTGC

SEQ ID NO: 1488 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXXXAYAACTGC

SEQ ID NO: 1489 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXXAXYAACTGC

SEQ ID NO: 1490 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXXAYXAACTGC

SEQ ID NO: 1491 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXXAYAXACTGC

SEQ ID NO: 1492 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXXAYAAXCTGC

SEQ ID NO: 1493 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXXAYAACXTGC

SEQ ID NO: 1494 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXXAYAACTXGC

SEQ ID NO: 1495 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXXAYAACTGXC

SEQ ID NO: 1496 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXXAYAACTGCX

SEQ ID NO: 1497 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICXAXYAACTGC

SEQ ID NO: 1498 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAXXYAACTGC

SEQ ID NO: 1499 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAXYXAACTGC

SEQ ID NO: 1500 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAXYAXACTGC

SEQ ID NO: 1501 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAXYAAXCTGC

SEQ ID NO: 1502 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAXYAACXTGC

SEQ ID NO: 1503 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAXYAACTXGC

SEQ ID NO: 1504 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAXYAACTGXC

SEQ ID NO: 1505 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAXYAACTGCX

SEQ ID NO: 1506 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICXAYXAACTGC

SEQ ID NO: 1507 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYXXAACTGC

SEQ ID NO: 1508 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYXAXACTGC

SEQ ID NO: 1509 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYXAAXCTGC

SEQ ID NO: 1510 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYXAACXTGC

SEQ ID NO: 1511 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYXAACTXGC

SEQ ID NO: 1512 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYXAACTGXC

SEQ ID NO: 1513 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYXAACTGCX

SEQ ID NO: 1514 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICXAYAXACTGC

SEQ ID NO: 1515 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAXXACTGC

SEQ ID NO: 1516 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAXAXCTGC

SEQ ID NO: 1517 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAXACXTGC

SEQ ID NO: 1518 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAXACTXGC

SEQ ID NO: 1519 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAXACTGXC

SEQ ID NO: 1520 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAXACTGCX

SEQ ID NO: 1521 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICXAYAAXCTGC

SEQ ID NO: 1522 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAAXXCTGC

SEQ ID NO: 1523 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAAXCXTGC

SEQ ID NO: 1524 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAAXCTXGC

SEQ ID NO: 1525 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAAXCTGXC

SEQ ID NO: 1526 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAAXCTGCX

SEQ ID NO: 1527 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICXAYAACXTGC

SEQ ID NO: 1528 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAACXXTGC

SEQ ID NO: 1529 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAACXTXGC

SEQ ID NO: 1530 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAACXTGXC

SEQ ID NO: 1531 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAACXTGCX

SEQ ID NO: 1532 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICXAYAACTXGC

SEQ ID NO: 1533 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAACTXXGC

SEQ ID NO: 1534 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAACTXGXC

SEQ ID NO: 1535 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAACTXGCX

SEQ ID NO: 1536 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICXAYAACTGXC

SEQ ID NO: 1537 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAACTGXXC

SEQ ID NO: 1538 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAACTGXCX

SEQ ID NO: 1539 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICXAYAACTGCX

SEQ ID NO: 1540 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICXAYAACTGCXX

SEQ ID NO: 1541 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTCGEICAXYAACTGC

SEQ ID NO: 1542 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAXXYAACTGC

SEQ ID NO: 1543 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXXXYAACTGC

SEQ ID NO: 1544 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXXYXAACTGC

SEQ ID NO: 1545 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXXYAXACTGC

SEQ ID NO: 1546 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXXYAAXCTGC

SEQ ID NO: 1547 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXXYAACXTGC

SEQ ID NO: 1548 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXXYAACTXGC

SEQ ID NO: 1549 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXXYAACTGXC

SEQ ID NO: 1550 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXXYAACTGCX

SEQ ID NO: 1551 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAXYXAACTGC

SEQ ID NO: 1552 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYXXAACTGC

SEQ ID NO: 1553 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYXAXACTGC

SEQ ID NO: 1554 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYXAAXCTGC

SEQ ID NO: 1555 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYXAACXTGC

SEQ ID NO: 1556 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYXAACTXGC

SEQ ID NO: 1557 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYXAACTGXC

SEQ ID NO: 1558 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYXAACTGCX

SEQ ID NO: 1559 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAXYAXACTGC

SEQ ID NO: 1560 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAXXACTGC

SEQ ID NO: 1561 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAXAXCTGC

SEQ ID NO: 1562 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAXACXTGC

SEQ ID NO: 1563 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAXACTXGC

SEQ ID NO: 1564 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAXACTGXC

SEQ ID NO: 1565 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAXACTGCX

SEQ ID NO: 1566 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAXYAAXCTGC

SEQ ID NO: 1567 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAAXXCTGC

SEQ ID NO: 1568 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAAXCXTGC

SEQ ID NO: 1569 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAAXCTXGC

SEQ ID NO: 1570 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAAXCTGXC

SEQ ID NO: 1571 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAAXCTGCX

SEQ ID NO: 1572 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAXYAACXTGC

SEQ ID NO: 1573 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAACXXTGC

SEQ ID NO: 1574 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAACXTXGC

SEQ ID NO: 1575 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAACXTGXC

SEQ ID NO: 1576 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAACXTGCX

SEQ ID NO: 1577 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAXYAACTXGC

SEQ ID NO: 1578 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAACTXXGC

SEQ ID NO: 1579 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAACTXGXC

SEQ ID NO: 1580 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAACTXGCX

SEQ ID NO: 1581 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAXYAACTGXC

SEQ ID NO: 1582 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAACTGXXC

SEQ ID NO: 1583 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAACTGXCX

SEQ ID NO: 1584 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAXYAACTGCX

SEQ ID NO: 1585 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAXYAACTGCXX

SEQ ID NO: 1586 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTCGEICAYXAACTGC

SEQ ID NO: 1587 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYXXAACTGC

SEQ ID NO: 1588 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXXXAACTGC

SEQ ID NO: 1589 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXXAXACTGC

SEQ ID NO: 1590 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXXAAXCTGC

SEQ ID NO: 1591 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXXAACXTGC

SEQ ID NO: 1592 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXXAACTXGC

SEQ ID NO: 1593 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXXAACTGXC

SEQ ID NO: 1594 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXXAACTGCX

SEQ ID NO: 1595 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYXAXACTGC

SEQ ID NO: 1596 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAXXACTGC

SEQ ID NO: 1597 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAXAXCTGC

SEQ ID NO: 1598 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAXACXTGC

SEQ ID NO: 1599 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAXACTXGC

SEQ ID NO: 1600 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAXACTGXC

SEQ ID NO: 1601 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAXACTGCX

SEQ ID NO: 1602 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYXAAXCTGC

SEQ ID NO: 1603 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAAXXCTGC

SEQ ID NO: 1604 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAAXCXTGC

SEQ ID NO: 1605 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAAXCTXGC

SEQ ID NO: 1606 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAAXCTGXC

SEQ ID NO: 1607 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAAXCTGCX

SEQ ID NO: 1608 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYXAACXTGC

SEQ ID NO: 1609 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAACXXTGC

SEQ ID NO: 1610 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAACXTXGC

SEQ ID NO: 1611 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAACXTGXC

SEQ ID NO: 1612 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAACXTGCX

SEQ ID NO: 1613 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYXAACTXGC

SEQ ID NO: 1614 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAACTXXGC

SEQ ID NO: 1615 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAACTXGXC

SEQ ID NO: 1616 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAACTXGCX

SEQ ID NO: 1617 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYXAACTGXC

SEQ ID NO: 1618 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAACTGXXC

SEQ ID NO: 1619 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAACTGXCX

SEQ ID NO: 1620 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYXAACTGCX

SEQ ID NO: 1621 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYXAACTGCXX

SEQ ID NO: 1622 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTCGEICAYAXACTGC

SEQ ID NO: 1623 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAXXACTGC

SEQ ID NO: 1624 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXXXACTGC

SEQ ID NO: 1625 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXXAXCTGC

SEQ ID NO: 1626 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXXACXTGC

SEQ ID NO: 1627 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXXACTXGC

SEQ ID NO: 1628 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXXACTGXC

SEQ ID NO: 1629 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXXACTGCX

SEQ ID NO: 1630 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAXAXCTGC

SEQ ID NO: 1631 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXAXXCTGC

SEQ ID NO: 1632 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXAXCXTGC

SEQ ID NO: 1633 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXAXCTXGC

SEQ ID NO: 1634 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXAXCTGXC

SEQ ID NO: 1635 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXAXCTGCX

SEQ ID NO: 1636 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAXACXTGC

SEQ ID NO: 1637 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXACXXTGC

SEQ ID NO: 1638 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXACXTXGC

SEQ ID NO: 1639 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXACXTGXC

SEQ ID NO: 1640 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXACXTGCX

SEQ ID NO: 1641 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAXACTXGC

SEQ ID NO: 1642 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXACTXXGC

SEQ ID NO: 1643 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXACTXGXC

SEQ ID NO: 1644 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXACTXGCX

SEQ ID NO: 1645 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAXACTGXC

SEQ ID NO: 1646 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXACTGXXC

SEQ ID NO: 1647 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXACTGXCX

SEQ ID NO: 1648 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAXACTGCX

SEQ ID NO: 1649 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAXACTGCXX

SEQ ID NO: 1650 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTCGEICAYAAXCTGC

SEQ ID NO: 1651 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAAXXCTGC

SEQ ID NO: 1652 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXXXCTGC

SEQ ID NO: 1653 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXXCXTGC

SEQ ID NO: 1654 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXXCTXGC

SEQ ID NO: 1655 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXXCTGXC

SEQ ID NO: 1656 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXXCTGCX

SEQ ID NO: 1657 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAAXCXTGC

SEQ ID NO: 1658 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXCXXTGC

SEQ ID NO: 1659 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXCXTXGC

SEQ ID NO: 1660 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXCXTGXC

SEQ ID NO: 1661 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXCXTGCX

SEQ ID NO: 1662 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAAXCTXGC

SEQ ID NO: 1663 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXCTXXGC

SEQ ID NO: 1664 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXCTXGXC

SEQ ID NO: 1665 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXCTXGCX

SEQ ID NO: 1666 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAAXCTGXC

SEQ ID NO: 1667 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXCTGXXC

SEQ ID NO: 1668 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXCTGXCX

SEQ ID NO: 1669 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAAXCTGCX

SEQ ID NO: 1670 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAAXCTGCXX

SEQ ID NO: 1671 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTCGEICAYAACXTGC

SEQ ID NO: 1672 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAACXXTGC

SEQ ID NO: 1673 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACXXXTGC

SEQ ID NO: 1674 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACXXTXGC

SEQ ID NO: 1675 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACXXTGXC

SEQ ID NO: 1676 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACXXTGCX

SEQ ID NO: 1677 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAACXTXGC

SEQ ID NO: 1678 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACXTXXGC

SEQ ID NO: 1679 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACXTXGXC

SEQ ID NO: 1680 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACXTXGCX

SEQ ID NO: 1681 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAACXTGXC

SEQ ID NO: 1682 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACXTGXXC

SEQ ID NO: 1683 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACXTGXCX

SEQ ID NO: 1684 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAACXTGCX

SEQ ID NO: 1685 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACXTGCXX

SEQ ID NO: 1686 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTCGEICAYAACTXGC

SEQ ID NO: 1687 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAACTXXGC

SEQ ID NO: 1688 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACTXXXGC

SEQ ID NO: 1689 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACTXXGXC

SEQ ID NO: 1690 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACTXXGCX

SEQ ID NO: 1691 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAACTXGXC

SEQ ID NO: 1692 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACTXGXXC

SEQ ID NO: 1693 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACTXGXCX

SEQ ID NO: 1694 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAACTXGCX

SEQ ID NO: 1695 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACTXGCXX

SEQ ID NO: 1696 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTCGEICAYAACTGXC

SEQ ID NO: 1697 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAACTGXXC

SEQ ID NO: 1698 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACTGXXXC

SEQ ID NO: 1699 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACTGXXCX

SEQ ID NO: 1700 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAACTGXCX

SEQ ID NO: 1701 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACTGXCXX

SEQ ID NO: 1702 - protein, 18 aa, Artificial Sequence
  Synthetically generated peptide
  VARIANT (1)...(18): Xaa = Any Amino Acid
  VARIANT (1)...(18): Xaa = Any Amino Acid
PGXTCGEICAYAACTGCX

SEQ ID NO: 1703 - protein, 19 aa, Artificial Sequence
  Synthetically generated peptide
  VARIANT (1)...(19): Xaa = Any Amino Acid
  VARIANT (1)...(19): Xaa = Any Amino Acid
PGXTCGEICAYAACTGCXX

SEQ ID NO: 1704 - protein, 20 aa, Artificial Sequence
  Synthetically generated peptide
  VARIANT (1)...(20): Xaa = Any Amino Acid
  VARIANT (1)...(20): Xaa = Any Amino Acid
PGXTCGEICAYAACTGCXXX

SEQ ID NO: 1705 - protein, 17 aa, Artificial Sequence
  Synthetically generated peptide
  VARIANT (1)...(17): Xaa = Any Amino Acid
  VARIANT (1)...(17): Xaa = Any Amino Acid
PGTXCGEICAYAACTGC

SEQ ID NO: 1706 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXXCGEICAYAACTGC

SEQ ID NO: 1707 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXXCGEICAYAACTGC

SEQ ID NO: 1708 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXXCGEICAYAACTGC

SEQ ID NO: 1709 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXCXGEICAYAACTGC

SEQ ID NO: 1710 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXCGXEICAYAACTGC

SEQ ID NO: 1711 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXCGEXICAYAACTGC

SEQ ID NO: 1712 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXCGEIXCAYAACTGC

SEQ ID NO: 1713 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXCGEICXAYAACTGC

SEQ ID NO: 1714 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXCGEICAXYAACTGC

SEQ ID NO: 1715 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXCGEICAYXAACTGC

SEQ ID NO: 1716 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXCGEICAYAXACTGC

SEQ ID NO: 1717 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXCGEICAYAAXCTGC

SEQ ID NO: 1718 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXCGEICAYAACXTGC

SEQ ID NO: 1719 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXCGEICAYAACTXGC

SEQ ID NO: 1720 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXCGEICAYAACTGXC

SEQ ID NO: 1721 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXXCGEICAYAACTGCX

SEQ ID NO: 1722 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXCXGEICAYAACTGC

SEQ ID NO: 1723 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCXXGEICAYAACTGC

SEQ ID NO: 1724 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCXGXEICAYAACTGC

SEQ ID NO: 1725 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCXGEXICAYAACTGC

SEQ ID NO: 1726 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCXGEIXCAYAACTGC

SEQ ID NO: 1727 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCXGEICXAYAACTGC

SEQ ID NO: 1728 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCXGEICAXYAACTGC

SEQ ID NO: 1729 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCXGEICAYXAACTGC

SEQ ID NO: 1730 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCXGEICAYAXACTGC

SEQ ID NO: 1731 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCXGEICAYAAXCTGC

SEQ ID NO: 1732 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCXGEICAYAACXTGC

SEQ ID NO: 1733 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCXGEICAYAACTXGC

SEQ ID NO: 1734 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCXGEICAYAACTGXC

SEQ ID NO: 1735 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCXGEICAYAACTGCX

SEQ ID NO: 1736 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXCGXEICAYAACTGC

SEQ ID NO: 1737 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGXXEICAYAACTGC

SEQ ID NO: 1738 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGXEXICAYAACTGC

SEQ ID NO: 1739 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGXEIXCAYAACTGC

SEQ ID NO: 1740 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGXEICXAYAACTGC

SEQ ID NO: 1741 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGXEICAXYAACTGC

SEQ ID NO: 1742 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGXEICAYXAACTGC

SEQ ID NO: 1743 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGXEICAYAXACTGC

SEQ ID NO: 1744 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGXEICAYAAXCTGC

SEQ ID NO: 1745 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGXEICAYAACXTGC

SEQ ID NO: 1746 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGXEICAYAACTXGC

SEQ ID NO: 1747 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGXEICAYAACTGXC

SEQ ID NO: 1748 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGXEICAYAACTGCX

SEQ ID NO: 1749 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXCGEXICAYAACTGC

SEQ ID NO: 1750 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEXXICAYAACTGC

SEQ ID NO: 1751 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEXIXCAYAACTGC

SEQ ID NO: 1752 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEXICXAYAACTGC

SEQ ID NO: 1753 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEXICAXYAACTGC

SEQ ID NO: 1754 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEXICAYXAACTGC

SEQ ID NO: 1755 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEXICAYAXACTGC

SEQ ID NO: 1756 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEXICAYAAXCTGC

SEQ ID NO: 1757 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEXICAYAACXTGC

SEQ ID NO: 1758 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEXICAYAACTXGC

SEQ ID NO: 1759 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEXICAYAACTGXC

SEQ ID NO: 1760 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEXICAYAACTGCX

SEQ ID NO: 1761 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXCGEIXCAYAACTGC

SEQ ID NO: 1762 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEIXXCAYAACTGC

SEQ ID NO: 1763 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEIXCXAYAACTGC

SEQ ID NO: 1764 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEIXCAXYAACTGC

SEQ ID NO: 1765 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEIXCAYXAACTGC

SEQ ID NO: 1766 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEIXCAYAXACTGC

SEQ ID NO: 1767 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEIXCAYAAXCTGC

SEQ ID NO: 1768 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEIXCAYAACXTGC

SEQ ID NO: 1769 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEIXCAYAACTXGC

SEQ ID NO: 1770 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEIXCAYAACTGXC

SEQ ID NO: 1771 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEIXCAYAACTGCX

SEQ ID NO: 1772 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXCGEICXAYAACTGC

SEQ ID NO: 1773 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICXXAYAACTGC

SEQ ID NO: 1774 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICXAXYAACTGC

SEQ ID NO: 1775 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICXAYXAACTGC

SEQ ID NO: 1776 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICXAYAXACTGC

SEQ ID NO: 1777 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICXAYAAXCTGC

SEQ ID NO: 1778 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICXAYAACXTGC

SEQ ID NO: 1779 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICXAYAACTXGC

SEQ ID NO: 1780 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICXAYAACTGXC

SEQ ID NO: 1781 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICXAYAACTGCX

SEQ ID NO: 1782 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXCGEICAXYAACTGC

SEQ ID NO: 1783 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAXXYAACTGC

SEQ ID NO: 1784 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAXYXAACTGC

SEQ ID NO: 1785 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAXYAXACTGC

SEQ ID NO: 1786 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAXYAAXCTGC

SEQ ID NO: 1787 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAXYAACXTGC

SEQ ID NO: 1788 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAXYAACTXGC

SEQ ID NO: 1789 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAXYAACTGXC

SEQ ID NO: 1790 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAXYAACTGCX

SEQ ID NO: 1791 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXCGEICAYXAACTGC

SEQ ID NO: 1792 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYXXAACTGC

SEQ ID NO: 1793 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYXAXACTGC

SEQ ID NO: 1794 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYXAAXCTGC

SEQ ID NO: 1795 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYXAACXTGC

SEQ ID NO: 1796 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYXAACTXGC

SEQ ID NO: 1797 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYXAACTGXC

SEQ ID NO: 1798 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYXAACTGCX

SEQ ID NO: 1799 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXCGEICAYAXACTGC

SEQ ID NO: 1800 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAXXACTGC

SEQ ID NO: 1801 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAXAXCTGC

SEQ ID NO: 1802 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAXACXTGC

SEQ ID NO: 1803 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAXACTXGC

SEQ ID NO: 1804 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAXACTGXC

SEQ ID NO: 1805 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAXACTGCX

SEQ ID NO: 1806 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXCGEICAYAAXCTGC

SEQ ID NO: 1807 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAAXXCTGC

SEQ ID NO: 1808 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAAXCXTGC

SEQ ID NO: 1809 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAAXCTXGC

SEQ ID NO: 1810 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAAXCTGXC

SEQ ID NO: 1811 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAAXCTGCX

SEQ ID NO: 1812 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXCGEICAYAACXTGC

SEQ ID NO: 1813 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAACXXTGC

SEQ ID NO: 1814 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAACXTXGC

SEQ ID NO: 1815 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAACXTGXC

SEQ ID NO: 1816 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAACXTGCX

SEQ ID NO: 1817 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXCGEICAYAACTXGC

SEQ ID NO: 1818 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAACTXXGC

SEQ ID NO: 1819 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAACTXGXC

SEQ ID NO: 1820 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAACTXGCX

SEQ ID NO: 1821 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXCGEICAYAACTGXC

SEQ ID NO: 1822 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAACTGXXC

SEQ ID NO: 1823 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAACTGXCX

SEQ ID NO: 1824 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXXCGEICAYAACTGCX

SEQ ID NO: 1825 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXXCGEICAYAACTGCXX

SEQ ID NO: 1826 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXCXGEICAYAACTGC

SEQ ID NO: 1827 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCXXGEICAYAACTGC

SEQ ID NO: 1828 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXXXGEICAYAACTGC

SEQ ID NO: 1829 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXXGXEICAYAACTGC

SEQ ID NO: 1830 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXXGEXICAYAACTGC

SEQ ID NO: 1831 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXXGEIXCAYAACTGC

SEQ ID NO: 1832 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXXGEICXAYAACTGC

SEQ ID NO: 1833 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXXGEICAXYAACTGC

SEQ ID NO: 1834 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXXGEICAYXAACTGC

SEQ ID NO: 1835 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXXGEICAYAXACTGC

SEQ ID NO: 1836 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXXGEICAYAAXCTGC

SEQ ID NO: 1837 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXXGEICAYAACXTGC

SEQ ID NO: 1838 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXXGEICAYAACTXGC

SEQ ID NO: 1839 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXXGEICAYAACTGXC

SEQ ID NO: 1840 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXXGEICAYAACTGCX

SEQ ID NO: 1841 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCXGXEICAYAACTGC

SEQ ID NO: 1842 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGXXEICAYAACTGC

SEQ ID NO: 1843 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGXEXICAYAACTGC

SEQ ID NO: 1844 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGXEIXCAYAACTGC

SEQ ID NO: 1845 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGXEICXAYAACTGC

SEQ ID NO: 1846 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGXEICAXYAACTGC

SEQ ID NO: 1847 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGXEICAYXAACTGC

SEQ ID NO: 1848 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGXEICAYAXACTGC

SEQ ID NO: 1849 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGXEICAYAAXCTGC

SEQ ID NO: 1850 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGXEICAYAACXTGC

SEQ ID NO: 1851 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGXEICAYAACTXGC

SEQ ID NO: 1852 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGXEICAYAACTGXC

SEQ ID NO: 1853 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGXEICAYAACTGCX

SEQ ID NO: 1854 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCXGEXICAYAACTGC

SEQ ID NO: 1855 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEXXICAYAACTGC

SEQ ID NO: 1856 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEXIXCAYAACTGC

SEQ ID NO: 1857 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEXICXAYAACTGC

SEQ ID NO: 1858 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEXICAXYAACTGC

SEQ ID NO: 1859 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEXICAYXAACTGC

SEQ ID NO: 1860 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEXICAYAXACTGC

SEQ ID NO: 1861 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEXICAYAAXCTGC

SEQ ID NO: 1862 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEXICAYAACXTGC

SEQ ID NO: 1863 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEXICAYAACTXGC

SEQ ID NO: 1864 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEXICAYAACTGXC

SEQ ID NO: 1865 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEXICAYAACTGCX

SEQ ID NO: 1866 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCXGEIXCAYAACTGC

SEQ ID NO: 1867 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEIXXCAYAACTGC

SEQ ID NO: 1868 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEIXCXAYAACTGC

SEQ ID NO: 1869 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEIXCAXYAACTGC

SEQ ID NO: 1870 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEIXCAYXAACTGC

SEQ ID NO: 1871 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEIXCAYAXACTGC

SEQ ID NO: 1872 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEIXCAYAAXCTGC

SEQ ID NO: 1873 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEIXCAYAACXTGC

SEQ ID NO: 1874 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEIXCAYAACTXGC

SEQ ID NO: 1875 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEIXCAYAACTGXC

SEQ ID NO: 1876 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEIXCAYAACTGCX

SEQ ID NO: 1877 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCXGEICXAYAACTGC

SEQ ID NO: 1878 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICXXAYAACTGC

SEQ ID NO: 1879 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICXAXYAACTGC

SEQ ID NO: 1880 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICXAYXAACTGC

SEQ ID NO: 1881 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICXAYAXACTGC

SEQ ID NO: 1882 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICXAYAAXCTGC

SEQ ID NO: 1883 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICXAYAACXTGC

SEQ ID NO: 1884 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICXAYAACTXGC

SEQ ID NO: 1885 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICXAYAACTGXC

SEQ ID NO: 1886 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICXAYAACTGCX

SEQ ID NO: 1887 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCXGEICAXYAACTGC

SEQ ID NO: 1888 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAXXYAACTGC

SEQ ID NO: 1889 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAXYXAACTGC

SEQ ID NO: 1890 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAXYAXACTGC

SEQ ID NO: 1891 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAXYAAXCTGC

SEQ ID NO: 1892 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAXYAACXTGC

SEQ ID NO: 1893 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAXYAACTXGC

SEQ ID NO: 1894 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAXYAACTGXC

SEQ ID NO: 1895 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAXYAACTGCX

SEQ ID NO: 1896 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCXGEICAYXAACTGC

SEQ ID NO: 1897 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYXXAACTGC

SEQ ID NO: 1898 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYXAXACTGC

SEQ ID NO: 1899 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYXAAXCTGC

SEQ ID NO: 1900 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYXAACXTGC

SEQ ID NO: 1901 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYXAACTXGC

SEQ ID NO: 1902 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYXAACTGXC

SEQ ID NO: 1903 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYXAACTGCX

SEQ ID NO: 1904 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCXGEICAYAXACTGC

SEQ ID NO: 1905 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAXXACTGC

SEQ ID NO: 1906 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAXAXCTGC

SEQ ID NO: 1907 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAXACXTGC

SEQ ID NO: 1908 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAXACTXGC

SEQ ID NO: 1909 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAXACTGXC

SEQ ID NO: 1910 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAXACTGCX

SEQ ID NO: 1911 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCXGEICAYAAXCTGC

SEQ ID NO: 1912 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAAXXCTGC

SEQ ID NO: 1913 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAAXCXTGC

SEQ ID NO: 1914 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAAXCTXGC

SEQ ID NO: 1915 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAAXCTGXC

SEQ ID NO: 1916 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAAXCTGCX

SEQ ID NO: 1917 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCXGEICAYAACXTGC

SEQ ID NO: 1918 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAACXXTGC

SEQ ID NO: 1919 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAACXTXGC

SEQ ID NO: 1920 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAACXTGXC

SEQ ID NO: 1921 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAACXTGCX

SEQ ID NO: 1922 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCXGEICAYAACTXGC

SEQ ID NO: 1923 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAACTXXGC

SEQ ID NO: 1924 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAACTXGXC

SEQ ID NO: 1925 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAACTXGCX

SEQ ID NO: 1926 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCXGEICAYAACTGXC

SEQ ID NO: 1927 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAACTGXXC

SEQ ID NO: 1928 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAACTGXCX

SEQ ID NO: 1929 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCXGEICAYAACTGCX

SEQ ID NO: 1930 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCXGEICAYAACTGCXX

SEQ ID NO: 1931 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXCGXEICAYAACTGC

SEQ ID NO: 1932 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGXXEICAYAACTGC

SEQ ID NO: 1933 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXXXEICAYAACTGC

SEQ ID NO: 1934 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXXEXICAYAACTGC

SEQ ID NO: 1935 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXXEIXCAYAACTGC

SEQ ID NO: 1936 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXXEICXAYAACTGC

SEQ ID NO: 1937 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXXEICAXYAACTGC

SEQ ID NO: 1938 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXXEICAYXAACTGC

SEQ ID NO: 1939 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXXEICAYAXACTGC

SEQ ID NO: 1940 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXXEICAYAAXCTGC

SEQ ID NO: 1941 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXXEICAYAACXTGC

SEQ ID NO: 1942 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXXEICAYAACTXGC

SEQ ID NO: 1943 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXXEICAYAACTGXC

SEQ ID NO: 1944 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXXEICAYAACTGCX

SEQ ID NO: 1945 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGXEXICAYAACTGC

SEQ ID NO: 1946 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEXXICAYAACTGC

SEQ ID NO: 1947 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEXIXCAYAACTGC

SEQ ID NO: 1948 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEXICXAYAACTGC

SEQ ID NO: 1949 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEXICAXYAACTGC

SEQ ID NO: 1950 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEXICAYXAACTGC

SEQ ID NO: 1951 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEXICAYAXACTGC

SEQ ID NO: 1952 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEXICAYAAXCTGC

SEQ ID NO: 1953 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEXICAYAACXTGC

SEQ ID NO: 1954 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEXICAYAACTXGC

SEQ ID NO: 1955 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEXICAYAACTGXC

SEQ ID NO: 1956 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEXICAYAACTGCX

SEQ ID NO: 1957 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGXEIXCAYAACTGC

SEQ ID NO: 1958 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEIXXCAYAACTGC

SEQ ID NO: 1959 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEIXCXAYAACTGC

SEQ ID NO: 1960 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEIXCAXYAACTGC

SEQ ID NO: 1961 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEIXCAYXAACTGC

SEQ ID NO: 1962 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEIXCAYAXACTGC

SEQ ID NO: 1963 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEIXCAYAAXCTGC

SEQ ID NO: 1964 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEIXCAYAACXTGC

SEQ ID NO: 1965 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEIXCAYAACTXGC

SEQ ID NO: 1966 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEIXCAYAACTGXC

SEQ ID NO: 1967 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEIXCAYAACTGCX

SEQ ID NO: 1968 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGXEICXAYAACTGC

SEQ ID NO: 1969 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICXXAYAACTGC

SEQ ID NO: 1970 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICXAXYAACTGC

SEQ ID NO: 1971 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICXAYXAACTGC

SEQ ID NO: 1972 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICXAYAXACTGC

SEQ ID NO: 1973 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICXAYAAXCTGC

SEQ ID NO: 1974 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICXAYAACXTGC

SEQ ID NO: 1975 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICXAYAACTXGC

SEQ ID NO: 1976 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICXAYAACTGXC

SEQ ID NO: 1977 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICXAYAACTGCX

SEQ ID NO: 1978 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGXEICAXYAACTGC

SEQ ID NO: 1979 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAXXYAACTGC

SEQ ID NO: 1980 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAXYXAACTGC

SEQ ID NO: 1981 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAXYAXACTGC

SEQ ID NO: 1982 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAXYAAXCTGC

SEQ ID NO: 1983 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAXYAACXTGC

SEQ ID NO: 1984 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAXYAACTXGC

SEQ ID NO: 1985 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAXYAACTGXC

SEQ ID NO: 1986 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAXYAACTGCX

SEQ ID NO: 1987 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGXEICAYXAACTGC

SEQ ID NO: 1988 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYXXAACTGC

SEQ ID NO: 1989 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYXAXACTGC

SEQ ID NO: 1990 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYXAAXCTGC

SEQ ID NO: 1991 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYXAACXTGC

SEQ ID NO: 1992 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYXAACTXGC

SEQ ID NO: 1993 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYXAACTGXC

SEQ ID NO: 1994 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYXAACTGCX

SEQ ID NO: 1995 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGXEICAYAXACTGC

SEQ ID NO: 1996 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAXXACTGC

SEQ ID NO: 1997 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAXAXCTGC

SEQ ID NO: 1998 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAXACXTGC

SEQ ID NO: 1999 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAXACTXGC

SEQ ID NO: 2000 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAXACTGXC

SEQ ID NO: 2001 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAXACTGCX

SEQ ID NO: 2002 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGXEICAYAAXCTGC

SEQ ID NO: 2003 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAAXXCTGC

SEQ ID NO: 2004 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAAXCXTGC

SEQ ID NO: 2005 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAAXCTXGC

SEQ ID NO: 2006 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAAXCTGXC

SEQ ID NO: 2007 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAAXCTGCX

SEQ ID NO: 2008 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGXEICAYAACXTGC

SEQ ID NO: 2009 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAACXXTGC

SEQ ID NO: 2010 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAACXTXGC

SEQ ID NO: 2011 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAACXTGXC

SEQ ID NO: 2012 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAACXTGCX

SEQ ID NO: 2013 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGXEICAYAACTXGC

SEQ ID NO: 2014 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAACTXXGC

SEQ ID NO: 2015 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAACTXGXC

SEQ ID NO: 2016 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAACTXGCX

SEQ ID NO: 2017 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGXEICAYAACTGXC

SEQ ID NO: 2018 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAACTGXXC

SEQ ID NO: 2019 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAACTGXCX

SEQ ID NO: 2020 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGXEICAYAACTGCX

SEQ ID NO: 2021 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGXEICAYAACTGCXX

SEQ ID NO: 2022 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXCGEXICAYAACTGC

SEQ ID NO: 2023 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEXXICAYAACTGC

SEQ ID NO: 2024 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXXXICAYAACTGC

SEQ ID NO: 2025 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXXIXCAYAACTGC

SEQ ID NO: 2026 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXXICXAYAACTGC

SEQ ID NO: 2027 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXXICAXYAACTGC

SEQ ID NO: 2028 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXXICAYXAACTGC

SEQ ID NO: 2029 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXXICAYAXACTGC

SEQ ID NO: 2030 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXXICAYAAXCTGC

SEQ ID NO: 2031 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXXICAYAACXTGC

SEQ ID NO: 2032 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXXICAYAACTXGC

SEQ ID NO: 2033 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXXICAYAACTGXC

SEQ ID NO: 2034 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXXICAYAACTGCX

SEQ ID NO: 2035 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEXIXCAYAACTGC

SEQ ID NO: 2036 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXIXXCAYAACTGC

SEQ ID NO: 2037 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXIXCXAYAACTGC

SEQ ID NO: 2038 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXIXCAXYAACTGC

SEQ ID NO: 2039 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXIXCAYXAACTGC

SEQ ID NO: 2040 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXIXCAYAXACTGC

SEQ ID NO: 2041 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXIXCAYAAXCTGC

SEQ ID NO: 2042 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXIXCAYAACXTGC

SEQ ID NO: 2043 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXIXCAYAACTXGC

SEQ ID NO: 2044 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXIXCAYAACTGXC

SEQ ID NO: 2045 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXIXCAYAACTGCX

SEQ ID NO: 2046 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEXICXAYAACTGC

SEQ ID NO: 2047 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICXXAYAACTGC

SEQ ID NO: 2048 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICXAXYAACTGC

SEQ ID NO: 2049 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICXAYXAACTGC

SEQ ID NO: 2050 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICXAYAXACTGC

SEQ ID NO: 2051 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICXAYAAXCTGC

SEQ ID NO: 2052 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICXAYAACXTGC

SEQ ID NO: 2053 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICXAYAACTXGC

SEQ ID NO: 2054 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICXAYAACTGXC

SEQ ID NO: 2055 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICXAYAACTGCX

SEQ ID NO: 2056 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEXICAXYAACTGC

SEQ ID NO: 2057 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAXXYAACTGC

SEQ ID NO: 2058 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAXYXAACTGC

SEQ ID NO: 2059 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAXYAXACTGC

SEQ ID NO: 2060 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAXYAAXCTGC

SEQ ID NO: 2061 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAXYAACXTGC

SEQ ID NO: 2062 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAXYAACTXGC

SEQ ID NO: 2063 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAXYAACTGXC

SEQ ID NO: 2064 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAXYAACTGCX

SEQ ID NO: 2065 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEXICAYXAACTGC

SEQ ID NO: 2066 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYXXAACTGC

SEQ ID NO: 2067 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYXAXACTGC

SEQ ID NO: 2068 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYXAAXCTGC

SEQ ID NO: 2069 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYXAACXTGC

SEQ ID NO: 2070 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYXAACTXGC

SEQ ID NO: 2071 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYXAACTGXC

SEQ ID NO: 2072 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYXAACTGCX

SEQ ID NO: 2073 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEXICAYAXACTGC

SEQ ID NO: 2074 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAXXACTGC

SEQ ID NO: 2075 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAXAXCTGC

SEQ ID NO: 2076 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAXACXTGC

SEQ ID NO: 2077 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAXACTXGC

SEQ ID NO: 2078 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAXACTGXC

SEQ ID NO: 2079 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAXACTGCX

SEQ ID NO: 2080 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEXICAYAAXCTGC

SEQ ID NO: 2081 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAAXXCTGC

SEQ ID NO: 2082 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAAXCXTGC

SEQ ID NO: 2083 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAAXCTXGC

SEQ ID NO: 2084 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAAXCTGXC

SEQ ID NO: 2085 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAAXCTGCX

SEQ ID NO: 2086 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEXICAYAACXTGC

SEQ ID NO: 2087 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAACXXTGC

SEQ ID NO: 2088 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAACXTXGC

SEQ ID NO: 2089 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAACXTGXC

SEQ ID NO: 2090 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAACXTGCX

SEQ ID NO: 2091 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEXICAYAACTXGC

SEQ ID NO: 2092 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAACTXXGC

SEQ ID NO: 2093 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAACTXGXC

SEQ ID NO: 2094 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAACTXGCX

SEQ ID NO: 2095 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEXICAYAACTGXC

SEQ ID NO: 2096 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAACTGXXC

SEQ ID NO: 2097 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAACTGXCX

SEQ ID NO: 2098 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEXICAYAACTGCX

SEQ ID NO: 2099 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEXICAYAACTGCXX

SEQ ID NO: 2100 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXCGEIXCAYAACTGC

SEQ ID NO: 2101 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEIXXCAYAACTGC

SEQ ID NO: 2102 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXXXCAYAACTGC

SEQ ID NO: 2103 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXXCXAYAACTGC

SEQ ID NO: 2104 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXXCAXYAACTGC

SEQ ID NO: 2105 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXXCAYXAACTGC

SEQ ID NO: 2106 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXXCAYAXACTGC

SEQ ID NO: 2107 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXXCAYAAXCTGC

SEQ ID NO: 2108 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXXCAYAACXTGC

SEQ ID NO: 2109 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXXCAYAACTXGC

SEQ ID NO: 2110 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXXCAYAACTGXC

SEQ ID NO: 2111 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXXCAYAACTGCX

SEQ ID NO: 2112 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEIXCXAYAACTGC

SEQ ID NO: 2113 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCXXAYAACTGC

SEQ ID NO: 2114 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCXAXYAACTGC

SEQ ID NO: 2115 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCXAYXAACTGC

SEQ ID NO: 2116 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCXAYAXACTGC

SEQ ID NO: 2117 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCXAYAAXCTGC

SEQ ID NO: 2118 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCXAYAACXTGC

SEQ ID NO: 2119 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCXAYAACTXGC

SEQ ID NO: 2120 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCXAYAACTGXC

SEQ ID NO: 2121 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCXAYAACTGCX

SEQ ID NO: 2122 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEIXCAXYAACTGC

SEQ ID NO: 2123 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAXXYAACTGC

SEQ ID NO: 2124 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAXYXAACTGC

SEQ ID NO: 2125 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAXYAXACTGC

SEQ ID NO: 2126 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAXYAAXCTGC

SEQ ID NO: 2127 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAXYAACXTGC

SEQ ID NO: 2128 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAXYAACTXGC

SEQ ID NO: 2129 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAXYAACTGXC

SEQ ID NO: 2130 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAXYAACTGCX

SEQ ID NO: 2131 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEIXCAYXAACTGC

SEQ ID NO: 2132 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYXXAACTGC

SEQ ID NO: 2133 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYXAXACTGC

SEQ ID NO: 2134 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYXAAXCTGC

SEQ ID NO: 2135 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYXAACXTGC

SEQ ID NO: 2136 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYXAACTXGC

SEQ ID NO: 2137 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYXAACTGXC

SEQ ID NO: 2138 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYXAACTGCX

SEQ ID NO: 2139 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEIXCAYAXACTGC

SEQ ID NO: 2140 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAXXACTGC

SEQ ID NO: 2141 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAXAXCTGC

SEQ ID NO: 2142 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAXACXTGC

SEQ ID NO: 2143 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAXACTXGC

SEQ ID NO: 2144 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAXACTGXC

SEQ ID NO: 2145 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAXACTGCX

SEQ ID NO: 2146 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEIXCAYAAXCTGC

SEQ ID NO: 2147 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAAXXCTGC

SEQ ID NO: 2148 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAAXCXTGC

SEQ ID NO: 2149 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAAXCTXGC

SEQ ID NO: 2150 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAAXCTGXC

SEQ ID NO: 2151 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAAXCTGCX

SEQ ID NO: 2152 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEIXCAYAACXTGC

SEQ ID NO: 2153 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAACXXTGC

SEQ ID NO: 2154 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAACXTXGC

SEQ ID NO: 2155 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAACXTGXC

SEQ ID NO: 2156 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAACXTGCX

SEQ ID NO: 2157 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEIXCAYAACTXGC

SEQ ID NO: 2158 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAACTXXGC

SEQ ID NO: 2159 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAACTXGXC

SEQ ID NO: 2160 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAACTXGCX

SEQ ID NO: 2161 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEIXCAYAACTGXC

SEQ ID NO: 2162 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAACTGXXC

SEQ ID NO: 2163 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAACTGXCX

SEQ ID NO: 2164 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEIXCAYAACTGCX

SEQ ID NO: 2165 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEIXCAYAACTGCXX

SEQ ID NO: 2166 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXCGEICXAYAACTGC

SEQ ID NO: 2167 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICXXAYAACTGC

SEQ ID NO: 2168 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXXXAYAACTGC

SEQ ID NO: 2169 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXXAXYAACTGC

SEQ ID NO: 2170 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXXAYXAACTGC

SEQ ID NO: 2171 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXXAYAXACTGC

SEQ ID NO: 2172 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXXAYAAXCTGC

SEQ ID NO: 2173 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXXAYAACXTGC

SEQ ID NO: 2174 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXXAYAACTXGC

SEQ ID NO: 2175 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXXAYAACTGXC

SEQ ID NO: 2176 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXXAYAACTGCX

SEQ ID NO: 2177 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICXAXYAACTGC

SEQ ID NO: 2178 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAXXYAACTGC

SEQ ID NO: 2179 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAXYXAACTGC

SEQ ID NO: 2180 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAXYAXACTGC

SEQ ID NO: 2181 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAXYAAXCTGC

SEQ ID NO: 2182 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAXYAACXTGC

SEQ ID NO: 2183 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAXYAACTXGC

SEQ ID NO: 2184 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAXYAACTGXC

SEQ ID NO: 2185 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAXYAACTGCX

SEQ ID NO: 2186 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICXAYXAACTGC

SEQ ID NO: 2187 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYXXAACTGC

SEQ ID NO: 2188 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYXAXACTGC

SEQ ID NO: 2189 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYXAAXCTGC

SEQ ID NO: 2190 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYXAACXTGC

SEQ ID NO: 2191 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYXAACTXGC

SEQ ID NO: 2192 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYXAACTGXC

SEQ ID NO: 2193 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYXAACTGCX

SEQ ID NO: 2194 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICXAYAXACTGC

SEQ ID NO: 2195 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAXXACTGC

SEQ ID NO: 2196 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAXAXCTGC

SEQ ID NO: 2197 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAXACXTGC

SEQ ID NO: 2198 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAXACTXGC

SEQ ID NO: 2199 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAXACTGXC

SEQ ID NO: 2200 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAXACTGCX

SEQ ID NO: 2201 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICXAYAAXCTGC

SEQ ID NO: 2202 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAAXXCTGC

SEQ ID NO: 2203 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAAXCXTGC

SEQ ID NO: 2204 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAAXCTXGC

SEQ ID NO: 2205 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAAXCTGXC

SEQ ID NO: 2206 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAAXCTGCX

SEQ ID NO: 2207 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICXAYAACXTGC

SEQ ID NO: 2208 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAACXXTGC

SEQ ID NO: 2209 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAACXTXGC

SEQ ID NO: 2210 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAACXTGXC

SEQ ID NO: 2211 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAACXTGCX

SEQ ID NO: 2212 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICXAYAACTXGC

SEQ ID NO: 2213 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAACTXXGC

SEQ ID NO: 2214 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAACTXGXC

SEQ ID NO: 2215 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAACTXGCX

SEQ ID NO: 2216 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICXAYAACTGXC

SEQ ID NO: 2217 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAACTGXXC

SEQ ID NO: 2218 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAACTGXCX

SEQ ID NO: 2219 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICXAYAACTGCX

SEQ ID NO: 2220 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICXAYAACTGCXX

SEQ ID NO: 2221 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXCGEICAXYAACTGC

SEQ ID NO: 2222 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAXXYAACTGC

SEQ ID NO: 2223 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXXXYAACTGC

SEQ ID NO: 2224 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXXYXAACTGC

SEQ ID NO: 2225 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXXYAXACTGC

SEQ ID NO: 2226 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXXYAAXCTGC

SEQ ID NO: 2227 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXXYAACXTGC

SEQ ID NO: 2228 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXXYAACTXGC

SEQ ID NO: 2229 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXXYAACTGXC

SEQ ID NO: 2230 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXXYAACTGCX

SEQ ID NO: 2231 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAXYXAACTGC

SEQ ID NO: 2232 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYXXAACTGC

SEQ ID NO: 2233 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYXAXACTGC

SEQ ID NO: 2234 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYXAAXCTGC

SEQ ID NO: 2235 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYXAACXTGC

SEQ ID NO: 2236 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYXAACTXGC

SEQ ID NO: 2237 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYXAACTGXC

SEQ ID NO: 2238 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYXAACTGCX

SEQ ID NO: 2239 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAXYAXACTGC

SEQ ID NO: 2240 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAXXACTGC

SEQ ID NO: 2241 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAXAXCTGC

SEQ ID NO: 2242 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAXACXTGC

SEQ ID NO: 2243 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAXACTXGC

SEQ ID NO: 2244 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAXACTGXC

SEQ ID NO: 2245 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAXACTGCX

SEQ ID NO: 2246 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAXYAAXCTGC

SEQ ID NO: 2247 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAAXXCTGC

SEQ ID NO: 2248 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAAXCXTGC

SEQ ID NO: 2249 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAAXCTXGC

SEQ ID NO: 2250 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAAXCTGXC

SEQ ID NO: 2251 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAAXCTGCX

SEQ ID NO: 2252 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAXYAACXTGC

SEQ ID NO: 2253 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAACXXTGC

SEQ ID NO: 2254 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAACXTXGC

SEQ ID NO: 2255 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAACXTGXC

SEQ ID NO: 2256 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAACXTGCX

SEQ ID NO: 2257 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAXYAACTXGC

SEQ ID NO: 2258 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAACTXXGC

SEQ ID NO: 2259 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAACTXGXC

SEQ ID NO: 2260 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAACTXGCX

SEQ ID NO: 2261 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAXYAACTGXC

SEQ ID NO: 2262 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAACTGXXC

SEQ ID NO: 2263 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAACTGXCX

SEQ ID NO: 2264 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAXYAACTGCX

SEQ ID NO: 2265 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAXYAACTGCXX

SEQ ID NO: 2266 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXCGEICAYXAACTGC

SEQ ID NO: 2267 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYXXAACTGC

SEQ ID NO: 2268 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXXXAACTGC

SEQ ID NO: 2269 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXXAXACTGC

SEQ ID NO: 2270 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXXAAXCTGC

SEQ ID NO: 2271 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXXAACXTGC

SEQ ID NO: 2272 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXXAACTXGC

SEQ ID NO: 2273 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXXAACTGXC

SEQ ID NO: 2274 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXXAACTGCX

SEQ ID NO: 2275 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYXAXACTGC

SEQ ID NO: 2276 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAXXACTGC

SEQ ID NO: 2277 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAXAXCTGC

SEQ ID NO: 2278 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAXACXTGC

SEQ ID NO: 2279 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAXACTXGC

SEQ ID NO: 2280 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAXACTGXC

SEQ ID NO: 2281 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAXACTGCX

SEQ ID NO: 2282 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYXAAXCTGC

SEQ ID NO: 2283 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAAXXCTGC

SEQ ID NO: 2284 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAAXCXTGC

SEQ ID NO: 2285 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAAXCTXGC

SEQ ID NO: 2286 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAAXCTGXC

SEQ ID NO: 2287 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAAXCTGCX

SEQ ID NO: 2288 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYXAACXTGC

SEQ ID NO: 2289 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAACXXTGC

SEQ ID NO: 2290 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAACXTXGC

SEQ ID NO: 2291 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAACXTGXC

SEQ ID NO: 2292 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAACXTGCX

SEQ ID NO: 2293 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYXAACTXGC

SEQ ID NO: 2294 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAACTXXGC

SEQ ID NO: 2295 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAACTXGXC

SEQ ID NO: 2296 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAACTXGCX

SEQ ID NO: 2297 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYXAACTGXC

SEQ ID NO: 2298 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAACTGXXC

SEQ ID NO: 2299 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAACTGXCX

SEQ ID NO: 2300 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYXAACTGCX

SEQ ID NO: 2301 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYXAACTGCXX

SEQ ID NO: 2302 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXCGEICAYAXACTGC

SEQ ID NO: 2303 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAXXACTGC

SEQ ID NO: 2304 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXXXACTGC

SEQ ID NO: 2305 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXXAXCTGC

SEQ ID NO: 2306 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXXACXTGC

SEQ ID NO: 2307 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXXACTXGC

SEQ ID NO: 2308 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXXACTGXC

SEQ ID NO: 2309 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXXACTGCX

SEQ ID NO: 2310 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAXAXCTGC

SEQ ID NO: 2311 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXAXXCTGC

SEQ ID NO: 2312 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXAXCXTGC

SEQ ID NO: 2313 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXAXCTXGC

SEQ ID NO: 2314 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXAXCTGXC

SEQ ID NO: 2315 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXAXCTGCX

SEQ ID NO: 2316 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAXACXTGC

SEQ ID NO: 2317 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXACXXTGC

SEQ ID NO: 2318 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXACXTXGC

SEQ ID NO: 2319 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXACXTGXC

SEQ ID NO: 2320 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXACXTGCX

SEQ ID NO: 2321 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAXACTXGC

SEQ ID NO: 2322 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXACTXXGC

SEQ ID NO: 2323 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXACTXGXC

SEQ ID NO: 2324 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXACTXGCX

SEQ ID NO: 2325 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAXACTGXC

SEQ ID NO: 2326 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXACTGXXC

SEQ ID NO: 2327 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXACTGXCX

SEQ ID NO: 2328 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAXACTGCX

SEQ ID NO: 2329 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAXACTGCXX

SEQ ID NO: 2330 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXCGEICAYAAXCTGC

SEQ ID NO: 2331 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAAXXCTGC

SEQ ID NO: 2332 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXXXCTGC

SEQ ID NO: 2333 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXXCXTGC

SEQ ID NO: 2334 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXXCTXGC

SEQ ID NO: 2335 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXXCTGXC

SEQ ID NO: 2336 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXXCTGCX

SEQ ID NO: 2337 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAAXCXTGC

SEQ ID NO: 2338 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXCXXTGC

SEQ ID NO: 2339 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXCXTXGC

SEQ ID NO: 2340 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXCXTGXC

SEQ ID NO: 2341 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXCXTGCX

SEQ ID NO: 2342 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAAXCTXGC

SEQ ID NO: 2343 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXCTXXGC

SEQ ID NO: 2344 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXCTXGXC

SEQ ID NO: 2345 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXCTXGCX

SEQ ID NO: 2346 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAAXCTGXC

SEQ ID NO: 2347 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXCTGXXC

SEQ ID NO: 2348 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXCTGXCX

SEQ ID NO: 2349 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAAXCTGCX

SEQ ID NO: 2350 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAAXCTGCXX

SEQ ID NO: 2351 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXCGEICAYAACXTGC

SEQ ID NO: 2352 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAACXXTGC

SEQ ID NO: 2353 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACXXXTGC

SEQ ID NO: 2354 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACXXTXGC

SEQ ID NO: 2355 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACXXTGXC

SEQ ID NO: 2356 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACXXTGCX

SEQ ID NO: 2357 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAACXTXGC

SEQ ID NO: 2358 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACXTXXGC

SEQ ID NO: 2359 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACXTXGXC

SEQ ID NO: 2360 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACXTXGCX

SEQ ID NO: 2361 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAACXTGXC

SEQ ID NO: 2362 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACXTGXXC

SEQ ID NO: 2363 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACXTGXCX

SEQ ID NO: 2364 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAACXTGCX

SEQ ID NO: 2365 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACXTGCXX

SEQ ID NO: 2366 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXCGEICAYAACTXGC

SEQ ID NO: 2367 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAACTXXGC

SEQ ID NO: 2368 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACTXXXGC

SEQ ID NO: 2369 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACTXXGXC

SEQ ID NO: 2370 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACTXXGCX

SEQ ID NO: 2371 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAACTXGXC

SEQ ID NO: 2372 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACTXGXXC

SEQ ID NO: 2373 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACTXGXCX

SEQ ID NO: 2374 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAACTXGCX

SEQ ID NO: 2375 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACTXGCXX

SEQ ID NO: 2376 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXCGEICAYAACTGXC

SEQ ID NO: 2377 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAACTGXXC

SEQ ID NO: 2378 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACTGXXXC

SEQ ID NO: 2379 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACTGXXCX

SEQ ID NO: 2380 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAACTGXCX

SEQ ID NO: 2381 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACTGXCXX

SEQ ID NO: 2382 - protein, 18 aa, Artificial Sequence
  Synthetically generated peptide
  VARIANT (1)...(18): Xaa = Any Amino Acid
  VARIANT (1)...(18): Xaa = Any Amino Acid
PGTXCGEICAYAACTGCX

SEQ ID NO: 2383 - protein, 19 aa, Artificial Sequence
  Synthetically generated peptide
  VARIANT (1)...(19): Xaa = Any Amino Acid
  VARIANT (1)...(19): Xaa = Any Amino Acid
PGTXCGEICAYAACTGCXX

SEQ ID NO: 2384 - protein, 20 aa, Artificial Sequence
  Synthetically generated peptide
  VARIANT (1)...(20): Xaa = Any Amino Acid
  VARIANT (1)...(20): Xaa = Any Amino Acid
PGTXCGEICAYAACTGCXXX

SEQ ID NO: 2385 - protein, 17 aa, Artificial Sequence
  Synthetically generated peptide
  VARIANT (1)...(17): Xaa = Any Amino Acid
  VARIANT (1)...(17): Xaa = Any Amino Acid
PGTCXGEICAYAACTGC

SEQ ID NO: 2386 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCXXGEICAYAACTGC

SEQ ID NO: 2387 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXXXGEICAYAACTGC

SEQ ID NO: 2388 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXXXGEICAYAACTGC

SEQ ID NO: 2389 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXXGXEICAYAACTGC

SEQ ID NO: 2390 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXXGEXICAYAACTGC

SEQ ID NO: 2391 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXXGEIXCAYAACTGC

SEQ ID NO: 2392 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXXGEICXAYAACTGC

SEQ ID NO: 2393 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXXGEICAXYAACTGC

SEQ ID NO: 2394 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXXGEICAYXAACTGC

SEQ ID NO: 2395 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXXGEICAYAXACTGC

SEQ ID NO: 2396 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXXGEICAYAAXCTGC

SEQ ID NO: 2397 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXXGEICAYAACXTGC

SEQ ID NO: 2398 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXXGEICAYAACTXGC

SEQ ID NO: 2399 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXXGEICAYAACTGXC

SEQ ID NO: 2400 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXXGEICAYAACTGCX

SEQ ID NO: 2401 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXXGXEICAYAACTGC

SEQ ID NO: 2402 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGXXEICAYAACTGC

SEQ ID NO: 2403 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGXEXICAYAACTGC

SEQ ID NO: 2404 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGXEIXCAYAACTGC

SEQ ID NO: 2405 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGXEICXAYAACTGC

SEQ ID NO: 2406 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGXEICAXYAACTGC

SEQ ID NO: 2407 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGXEICAYXAACTGC

SEQ ID NO: 2408 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGXEICAYAXACTGC

SEQ ID NO: 2409 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGXEICAYAAXCTGC

SEQ ID NO: 2410 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGXEICAYAACXTGC

SEQ ID NO: 2411 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGXEICAYAACTXGC

SEQ ID NO: 2412 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGXEICAYAACTGXC

SEQ ID NO: 2413 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGXEICAYAACTGCX

SEQ ID NO: 2414 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXXGEXICAYAACTGC

SEQ ID NO: 2415 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEXXICAYAACTGC

SEQ ID NO: 2416 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEXIXCAYAACTGC

SEQ ID NO: 2417 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEXICXAYAACTGC

SEQ ID NO: 2418 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEXICAXYAACTGC

SEQ ID NO: 2419 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEXICAYXAACTGC

SEQ ID NO: 2420 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEXICAYAXACTGC

SEQ ID NO: 2421 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEXICAYAAXCTGC

SEQ ID NO: 2422 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEXICAYAACXTGC

SEQ ID NO: 2423 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEXICAYAACTXGC

SEQ ID NO: 2424 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEXICAYAACTGXC

SEQ ID NO: 2425 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEXICAYAACTGCX

SEQ ID NO: 2426 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXXGEIXCAYAACTGC

SEQ ID NO: 2427 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEIXXCAYAACTGC

SEQ ID NO: 2428 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEIXCXAYAACTGC

SEQ ID NO: 2429 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEIXCAXYAACTGC

SEQ ID NO: 2430 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEIXCAYXAACTGC

SEQ ID NO: 2431 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEIXCAYAXACTGC

SEQ ID NO: 2432 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEIXCAYAAXCTGC

SEQ ID NO: 2433 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEIXCAYAACXTGC

SEQ ID NO: 2434 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEIXCAYAACTXGC

SEQ ID NO: 2435 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEIXCAYAACTGXC

SEQ ID NO: 2436 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEIXCAYAACTGCX

SEQ ID NO: 2437 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXXGEICXAYAACTGC

SEQ ID NO: 2438 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICXXAYAACTGC

SEQ ID NO: 2439 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICXAXYAACTGC

SEQ ID NO: 2440 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICXAYXAACTGC

SEQ ID NO: 2441 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICXAYAXACTGC

SEQ ID NO: 2442 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICXAYAAXCTGC

SEQ ID NO: 2443 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICXAYAACXTGC

SEQ ID NO: 2444 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICXAYAACTXGC

SEQ ID NO: 2445 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICXAYAACTGXC

SEQ ID NO: 2446 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICXAYAACTGCX

SEQ ID NO: 2447 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXXGEICAXYAACTGC

SEQ ID NO: 2448 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAXXYAACTGC

SEQ ID NO: 2449 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAXYXAACTGC

SEQ ID NO: 2450 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAXYAXACTGC

SEQ ID NO: 2451 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAXYAAXCTGC

SEQ ID NO: 2452 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAXYAACXTGC

SEQ ID NO: 2453 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAXYAACTXGC

SEQ ID NO: 2454 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAXYAACTGXC

SEQ ID NO: 2455 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAXYAACTGCX

SEQ ID NO: 2456 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXXGEICAYXAACTGC

SEQ ID NO: 2457 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYXXAACTGC

SEQ ID NO: 2458 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYXAXACTGC

SEQ ID NO: 2459 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYXAAXCTGC

SEQ ID NO: 2460 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYXAACXTGC

SEQ ID NO: 2461 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYXAACTXGC

SEQ ID NO: 2462 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYXAACTGXC

SEQ ID NO: 2463 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYXAACTGCX

SEQ ID NO: 2464 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXXGEICAYAXACTGC

SEQ ID NO: 2465 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAXXACTGC

SEQ ID NO: 2466 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAXAXCTGC

SEQ ID NO: 2467 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAXACXTGC

SEQ ID NO: 2468 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAXACTXGC

SEQ ID NO: 2469 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAXACTGXC

SEQ ID NO: 2470 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAXACTGCX

SEQ ID NO: 2471 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXXGEICAYAAXCTGC

SEQ ID NO: 2472 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAAXXCTGC

SEQ ID NO: 2473 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAAXCXTGC

SEQ ID NO: 2474 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAAXCTXGC

SEQ ID NO: 2475 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAAXCTGXC

SEQ ID NO: 2476 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAAXCTGCX

SEQ ID NO: 2477 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXXGEICAYAACXTGC

SEQ ID NO: 2478 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAACXXTGC

SEQ ID NO: 2479 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAACXTXGC

SEQ ID NO: 2480 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAACXTGXC

SEQ ID NO: 2481 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAACXTGCX

SEQ ID NO: 2482 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXXGEICAYAACTXGC

SEQ ID NO: 2483 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAACTXXGC

SEQ ID NO: 2484 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAACTXGXC

SEQ ID NO: 2485 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAACTXGCX

SEQ ID NO: 2486 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXXGEICAYAACTGXC

SEQ ID NO: 2487 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAACTGXXC

SEQ ID NO: 2488 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAACTGXCX

SEQ ID NO: 2489 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXXGEICAYAACTGCX

SEQ ID NO: 2490 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXXGEICAYAACTGCXX

SEQ ID NO: 2491 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCXGXEICAYAACTGC

SEQ ID NO: 2492 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGXXEICAYAACTGC

SEQ ID NO: 2493 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXXXEICAYAACTGC

SEQ ID NO: 2494 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXXEXICAYAACTGC

SEQ ID NO: 2495 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXXEIXCAYAACTGC

SEQ ID NO: 2496 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXXEICXAYAACTGC

SEQ ID NO: 2497 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXXEICAXYAACTGC

SEQ ID NO: 2498 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXXEICAYXAACTGC

SEQ ID NO: 2499 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXXEICAYAXACTGC

SEQ ID NO: 2500 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXXEICAYAAXCTGC

SEQ ID NO: 2501 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXXEICAYAACXTGC

SEQ ID NO: 2502 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXXEICAYAACTXGC

SEQ ID NO: 2503 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXXEICAYAACTGXC

SEQ ID NO: 2504 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXXEICAYAACTGCX

SEQ ID NO: 2505 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGXEXICAYAACTGC

SEQ ID NO: 2506 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEXXICAYAACTGC

SEQ ID NO: 2507 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEXIXCAYAACTGC

SEQ ID NO: 2508 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEXICXAYAACTGC

SEQ ID NO: 2509 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEXICAXYAACTGC

SEQ ID NO: 2510 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEXICAYXAACTGC

SEQ ID NO: 2511 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEXICAYAXACTGC

SEQ ID NO: 2512 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEXICAYAAXCTGC

SEQ ID NO: 2513 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEXICAYAACXTGC

SEQ ID NO: 2514 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEXICAYAACTXGC

SEQ ID NO: 2515 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEXICAYAACTGXC

SEQ ID NO: 2516 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEXICAYAACTGCX

SEQ ID NO: 2517 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGXEIXCAYAACTGC

SEQ ID NO: 2518 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEIXXCAYAACTGC

SEQ ID NO: 2519 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEIXCXAYAACTGC

SEQ ID NO: 2520 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEIXCAXYAACTGC

SEQ ID NO: 2521 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEIXCAYXAACTGC

SEQ ID NO: 2522 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEIXCAYAXACTGC

SEQ ID NO: 2523 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEIXCAYAAXCTGC

SEQ ID NO: 2524 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEIXCAYAACXTGC

SEQ ID NO: 2525 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEIXCAYAACTXGC

SEQ ID NO: 2526 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEIXCAYAACTGXC

SEQ ID NO: 2527 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEIXCAYAACTGCX

SEQ ID NO: 2528 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGXEICXAYAACTGC

SEQ ID NO: 2529 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICXXAYAACTGC

SEQ ID NO: 2530 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICXAXYAACTGC

SEQ ID NO: 2531 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICXAYXAACTGC

SEQ ID NO: 2532 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICXAYAXACTGC

SEQ ID NO: 2533 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICXAYAAXCTGC

SEQ ID NO: 2534 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICXAYAACXTGC

SEQ ID NO: 2535 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICXAYAACTXGC

SEQ ID NO: 2536 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICXAYAACTGXC

SEQ ID NO: 2537 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICXAYAACTGCX

SEQ ID NO: 2538 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGXEICAXYAACTGC

SEQ ID NO: 2539 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAXXYAACTGC

SEQ ID NO: 2540 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAXYXAACTGC

SEQ ID NO: 2541 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAXYAXACTGC

SEQ ID NO: 2542 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAXYAAXCTGC

SEQ ID NO: 2543 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAXYAACXTGC

SEQ ID NO: 2544 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAXYAACTXGC

SEQ ID NO: 2545 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAXYAACTGXC

SEQ ID NO: 2546 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAXYAACTGCX

SEQ ID NO: 2547 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGXEICAYXAACTGC

SEQ ID NO: 2548 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYXXAACTGC

SEQ ID NO: 2549 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYXAXACTGC

SEQ ID NO: 2550 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYXAAXCTGC

SEQ ID NO: 2551 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYXAACXTGC

SEQ ID NO: 2552 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYXAACTXGC

SEQ ID NO: 2553 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYXAACTGXC

SEQ ID NO: 2554 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYXAACTGCX

SEQ ID NO: 2555 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGXEICAYAXACTGC

SEQ ID NO: 2556 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAXXACTGC

SEQ ID NO: 2557 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAXAXCTGC

SEQ ID NO: 2558 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAXACXTGC

SEQ ID NO: 2559 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAXACTXGC

SEQ ID NO: 2560 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAXACTGXC

SEQ ID NO: 2561 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAXACTGCX

SEQ ID NO: 2562 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGXEICAYAAXCTGC

SEQ ID NO: 2563 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAAXXCTGC

SEQ ID NO: 2564 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAAXCXTGC

SEQ ID NO: 2565 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAAXCTXGC

SEQ ID NO: 2566 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAAXCTGXC

SEQ ID NO: 2567 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAAXCTGCX

SEQ ID NO: 2568 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGXEICAYAACXTGC

SEQ ID NO: 2569 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAACXXTGC

SEQ ID NO: 2570 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAACXTXGC

SEQ ID NO: 2571 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAACXTGXC

SEQ ID NO: 2572 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAACXTGCX

SEQ ID NO: 2573 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGXEICAYAACTXGC

SEQ ID NO: 2574 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAACTXXGC

SEQ ID NO: 2575 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAACTXGXC

SEQ ID NO: 2576 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAACTXGCX

SEQ ID NO: 2577 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGXEICAYAACTGXC

SEQ ID NO: 2578 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAACTGXXC

SEQ ID NO: 2579 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAACTGXCX

SEQ ID NO: 2580 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGXEICAYAACTGCX

SEQ ID NO: 2581 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGXEICAYAACTGCXX

SEQ ID NO: 2582 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCXGEXICAYAACTGC

SEQ ID NO: 2583 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEXXICAYAACTGC

SEQ ID NO: 2584 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXXXICAYAACTGC

SEQ ID NO: 2585 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXXIXCAYAACTGC

SEQ ID NO: 2586 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXXICXAYAACTGC

SEQ ID NO: 2587 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXXICAXYAACTGC

SEQ ID NO: 2588 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXXICAYXAACTGC

SEQ ID NO: 2589 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXXICAYAXACTGC

SEQ ID NO: 2590 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXXICAYAAXCTGC

SEQ ID NO: 2591 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXXICAYAACXTGC

SEQ ID NO: 2592 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXXICAYAACTXGC

SEQ ID NO: 2593 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXXICAYAACTGXC

SEQ ID NO: 2594 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXXICAYAACTGCX

SEQ ID NO: 2595 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEXIXCAYAACTGC

SEQ ID NO: 2596 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXIXXCAYAACTGC

SEQ ID NO: 2597 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXIXCXAYAACTGC

SEQ ID NO: 2598 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXIXCAXYAACTGC

SEQ ID NO: 2599 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXIXCAYXAACTGC

SEQ ID NO: 2600 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXIXCAYAXACTGC

SEQ ID NO: 2601 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXIXCAYAAXCTGC

SEQ ID NO: 2602 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXIXCAYAACXTGC

SEQ ID NO: 2603 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXIXCAYAACTXGC

SEQ ID NO: 2604 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXIXCAYAACTGXC

SEQ ID NO: 2605 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXIXCAYAACTGCX

SEQ ID NO: 2606 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEXICXAYAACTGC

SEQ ID NO: 2607 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICXXAYAACTGC

SEQ ID NO: 2608 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICXAXYAACTGC

SEQ ID NO: 2609 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICXAYXAACTGC

SEQ ID NO: 2610 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICXAYAXACTGC

SEQ ID NO: 2611 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICXAYAAXCTGC

SEQ ID NO: 2612 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICXAYAACXTGC

SEQ ID NO: 2613 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICXAYAACTXGC

SEQ ID NO: 2614 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICXAYAACTGXC

SEQ ID NO: 2615 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICXAYAACTGCX

SEQ ID NO: 2616 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEXICAXYAACTGC

SEQ ID NO: 2617 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAXXYAACTGC

SEQ ID NO: 2618 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAXYXAACTGC

SEQ ID NO: 2619 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAXYAXACTGC

SEQ ID NO: 2620 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAXYAAXCTGC

SEQ ID NO: 2621 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAXYAACXTGC

SEQ ID NO: 2622 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAXYAACTXGC

SEQ ID NO: 2623 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAXYAACTGXC

SEQ ID NO: 2624 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAXYAACTGCX

SEQ ID NO: 2625 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEXICAYXAACTGC

SEQ ID NO: 2626 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYXXAACTGC

SEQ ID NO: 2627 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYXAXACTGC

SEQ ID NO: 2628 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYXAAXCTGC

SEQ ID NO: 2629 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYXAACXTGC

SEQ ID NO: 2630 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYXAACTXGC

SEQ ID NO: 2631 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYXAACTGXC

SEQ ID NO: 2632 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYXAACTGCX

SEQ ID NO: 2633 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEXICAYAXACTGC

SEQ ID NO: 2634 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAXXACTGC

SEQ ID NO: 2635 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAXAXCTGC

SEQ ID NO: 2636 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAXACXTGC

SEQ ID NO: 2637 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAXACTXGC

SEQ ID NO: 2638 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAXACTGXC

SEQ ID NO: 2639 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAXACTGCX

SEQ ID NO: 2640 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEXICAYAAXCTGC

SEQ ID NO: 2641 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAAXXCTGC

SEQ ID NO: 2642 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAAXCXTGC

SEQ ID NO: 2643 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAAXCTXGC

SEQ ID NO: 2644 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAAXCTGXC

SEQ ID NO: 2645 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAAXCTGCX

SEQ ID NO: 2646 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEXICAYAACXTGC

SEQ ID NO: 2647 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAACXXTGC

SEQ ID NO: 2648 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAACXTXGC

SEQ ID NO: 2649 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAACXTGXC

SEQ ID NO: 2650 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAACXTGCX

SEQ ID NO: 2651 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEXICAYAACTXGC

SEQ ID NO: 2652 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAACTXXGC

SEQ ID NO: 2653 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAACTXGXC

SEQ ID NO: 2654 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAACTXGCX

SEQ ID NO: 2655 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEXICAYAACTGXC

SEQ ID NO: 2656 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAACTGXXC

SEQ ID NO: 2657 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAACTGXCX

SEQ ID NO: 2658 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEXICAYAACTGCX

SEQ ID NO: 2659 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEXICAYAACTGCXX

SEQ ID NO: 2660 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCXGEIXCAYAACTGC

SEQ ID NO: 2661 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEIXXCAYAACTGC

SEQ ID NO: 2662 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXXXCAYAACTGC

SEQ ID NO: 2663 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXXCXAYAACTGC

SEQ ID NO: 2664 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXXCAXYAACTGC

SEQ ID NO: 2665 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXXCAYXAACTGC

SEQ ID NO: 2666 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXXCAYAXACTGC

SEQ ID NO: 2667 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXXCAYAAXCTGC

SEQ ID NO: 2668 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXXCAYAACXTGC

SEQ ID NO: 2669 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXXCAYAACTXGC

SEQ ID NO: 2670 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXXCAYAACTGXC

SEQ ID NO: 2671 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXXCAYAACTGCX

SEQ ID NO: 2672 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEIXCXAYAACTGC

SEQ ID NO: 2673 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCXXAYAACTGC

SEQ ID NO: 2674 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCXAXYAACTGC

SEQ ID NO: 2675 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCXAYXAACTGC

SEQ ID NO: 2676 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCXAYAXACTGC

SEQ ID NO: 2677 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCXAYAAXCTGC

SEQ ID NO: 2678 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCXAYAACXTGC

SEQ ID NO: 2679 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCXAYAACTXGC

SEQ ID NO: 2680 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCXAYAACTGXC

SEQ ID NO: 2681 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCXAYAACTGCX

SEQ ID NO: 2682 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEIXCAXYAACTGC

SEQ ID NO: 2683 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAXXYAACTGC

SEQ ID NO: 2684 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAXYXAACTGC

SEQ ID NO: 2685 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAXYAXACTGC

SEQ ID NO: 2686 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAXYAAXCTGC

SEQ ID NO: 2687 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAXYAACXTGC

SEQ ID NO: 2688 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAXYAACTXGC

SEQ ID NO: 2689 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAXYAACTGXC

SEQ ID NO: 2690 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAXYAACTGCX

SEQ ID NO: 2691 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEIXCAYXAACTGC

SEQ ID NO: 2692 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYXXAACTGC

SEQ ID NO: 2693 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYXAXACTGC

SEQ ID NO: 2694 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYXAAXCTGC

SEQ ID NO: 2695 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYXAACXTGC

SEQ ID NO: 2696 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYXAACTXGC

SEQ ID NO: 2697 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYXAACTGXC

SEQ ID NO: 2698 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYXAACTGCX

SEQ ID NO: 2699 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEIXCAYAXACTGC

SEQ ID NO: 2700 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAXXACTGC

SEQ ID NO: 2701 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAXAXCTGC

SEQ ID NO: 2702 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAXACXTGC

SEQ ID NO: 2703 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAXACTXGC

SEQ ID NO: 2704 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAXACTGXC

SEQ ID NO: 2705 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAXACTGCX

SEQ ID NO: 2706 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEIXCAYAAXCTGC

SEQ ID NO: 2707 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAAXXCTGC

SEQ ID NO: 2708 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAAXCXTGC

SEQ ID NO: 2709 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAAXCTXGC

SEQ ID NO: 2710 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAAXCTGXC

SEQ ID NO: 2711 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAAXCTGCX

SEQ ID NO: 2712 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEIXCAYAACXTGC

SEQ ID NO: 2713 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAACXXTGC

SEQ ID NO: 2714 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAACXTXGC

SEQ ID NO: 2715 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAACXTGXC

SEQ ID NO: 2716 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAACXTGCX

SEQ ID NO: 2717 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEIXCAYAACTXGC

SEQ ID NO: 2718 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAACTXXGC

SEQ ID NO: 2719 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAACTXGXC

SEQ ID NO: 2720 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAACTXGCX

SEQ ID NO: 2721 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEIXCAYAACTGXC

SEQ ID NO: 2722 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAACTGXXC

SEQ ID NO: 2723 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAACTGXCX

SEQ ID NO: 2724 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEIXCAYAACTGCX

SEQ ID NO: 2725 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEIXCAYAACTGCXX

SEQ ID NO: 2726 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCXGEICXAYAACTGC

SEQ ID NO: 2727 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICXXAYAACTGC

SEQ ID NO: 2728 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXXXAYAACTGC

SEQ ID NO: 2729 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXXAXYAACTGC

SEQ ID NO: 2730 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXXAYXAACTGC

SEQ ID NO: 2731 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXXAYAXACTGC

SEQ ID NO: 2732 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXXAYAAXCTGC

SEQ ID NO: 2733 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXXAYAACXTGC

SEQ ID NO: 2734 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXXAYAACTXGC

SEQ ID NO: 2735 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXXAYAACTGXC

SEQ ID NO: 2736 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXXAYAACTGCX

SEQ ID NO: 2737 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICXAXYAACTGC

SEQ ID NO: 2738 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAXXYAACTGC

SEQ ID NO: 2739 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAXYXAACTGC

SEQ ID NO: 2740 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAXYAXACTGC

SEQ ID NO: 2741 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAXYAAXCTGC

SEQ ID NO: 2742 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAXYAACXTGC

SEQ ID NO: 2743 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAXYAACTXGC

SEQ ID NO: 2744 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAXYAACTGXC

SEQ ID NO: 2745 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAXYAACTGCX

SEQ ID NO: 2746 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICXAYXAACTGC

SEQ ID NO: 2747 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYXXAACTGC

SEQ ID NO: 2748 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYXAXACTGC

SEQ ID NO: 2749 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYXAAXCTGC

SEQ ID NO: 2750 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYXAACXTGC

SEQ ID NO: 2751 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYXAACTXGC

SEQ ID NO: 2752 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYXAACTGXC

SEQ ID NO: 2753 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYXAACTGCX

SEQ ID NO: 2754 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICXAYAXACTGC

SEQ ID NO: 2755 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAXXACTGC

SEQ ID NO: 2756 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAXAXCTGC

SEQ ID NO: 2757 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAXACXTGC

SEQ ID NO: 2758 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAXACTXGC

SEQ ID NO: 2759 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAXACTGXC

SEQ ID NO: 2760 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAXACTGCX

SEQ ID NO: 2761 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICXAYAAXCTGC

SEQ ID NO: 2762 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAAXXCTGC

SEQ ID NO: 2763 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAAXCXTGC

SEQ ID NO: 2764 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAAXCTXGC

SEQ ID NO: 2765 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAAXCTGXC

SEQ ID NO: 2766 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAAXCTGCX

SEQ ID NO: 2767 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICXAYAACXTGC

SEQ ID NO: 2768 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAACXXTGC

SEQ ID NO: 2769 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAACXTXGC

SEQ ID NO: 2770 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAACXTGXC

SEQ ID NO: 2771 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAACXTGCX

SEQ ID NO: 2772 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICXAYAACTXGC

SEQ ID NO: 2773 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAACTXXGC

SEQ ID NO: 2774 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAACTXGXC

SEQ ID NO: 2775 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAACTXGCX

SEQ ID NO: 2776 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICXAYAACTGXC

SEQ ID NO: 2777 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAACTGXXC

SEQ ID NO: 2778 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAACTGXCX

SEQ ID NO: 2779 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICXAYAACTGCX

SEQ ID NO: 2780 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICXAYAACTGCXX

SEQ ID NO: 2781 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCXGEICAXYAACTGC

SEQ ID NO: 2782 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAXXYAACTGC

SEQ ID NO: 2783 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXXXYAACTGC

SEQ ID NO: 2784 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXXYXAACTGC

SEQ ID NO: 2785 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXXYAXACTGC

SEQ ID NO: 2786 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXXYAAXCTGC

SEQ ID NO: 2787 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXXYAACXTGC

SEQ ID NO: 2788 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXXYAACTXGC

SEQ ID NO: 2789 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXXYAACTGXC

SEQ ID NO: 2790 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXXYAACTGCX

SEQ ID NO: 2791 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAXYXAACTGC

SEQ ID NO: 2792 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYXXAACTGC

SEQ ID NO: 2793 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYXAXACTGC

SEQ ID NO: 2794 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYXAAXCTGC

SEQ ID NO: 2795 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYXAACXTGC

SEQ ID NO: 2796 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYXAACTXGC

SEQ ID NO: 2797 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYXAACTGXC

SEQ ID NO: 2798 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYXAACTGCX

SEQ ID NO: 2799 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAXYAXACTGC

SEQ ID NO: 2800 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAXXACTGC

SEQ ID NO: 2801 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAXAXCTGC

SEQ ID NO: 2802 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAXACXTGC

SEQ ID NO: 2803 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAXACTXGC

SEQ ID NO: 2804 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAXACTGXC

SEQ ID NO: 2805 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAXACTGCX

SEQ ID NO: 2806 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAXYAAXCTGC

SEQ ID NO: 2807 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAAXXCTGC

SEQ ID NO: 2808 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAAXCXTGC

SEQ ID NO: 2809 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAAXCTXGC

SEQ ID NO: 2810 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAAXCTGXC

SEQ ID NO: 2811 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAAXCTGCX

SEQ ID NO: 2812 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAXYAACXTGC

SEQ ID NO: 2813 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAACXXTGC

SEQ ID NO: 2814 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAACXTXGC

SEQ ID NO: 2815 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAACXTGXC

SEQ ID NO: 2816 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAACXTGCX

SEQ ID NO: 2817 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAXYAACTXGC

SEQ ID NO: 2818 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAACTXXGC

SEQ ID NO: 2819 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAACTXGXC

SEQ ID NO: 2820 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAACTXGCX

SEQ ID NO: 2821 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAXYAACTGXC

SEQ ID NO: 2822 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAACTGXXC

SEQ ID NO: 2823 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAACTGXCX

SEQ ID NO: 2824 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAXYAACTGCX

SEQ ID NO: 2825 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAXYAACTGCXX

SEQ ID NO: 2826 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCXGEICAYXAACTGC

SEQ ID NO: 2827 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYXXAACTGC

SEQ ID NO: 2828 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXXXAACTGC

SEQ ID NO: 2829 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXXAXACTGC

SEQ ID NO: 2830 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXXAAXCTGC

SEQ ID NO: 2831 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXXAACXTGC

SEQ ID NO: 2832 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXXAACTXGC

SEQ ID NO: 2833 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXXAACTGXC

SEQ ID NO: 2834 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXXAACTGCX

SEQ ID NO: 2835 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYXAXACTGC

SEQ ID NO: 2836 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAXXACTGC

SEQ ID NO: 2837 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAXAXCTGC

SEQ ID NO: 2838 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAXACXTGC

SEQ ID NO: 2839 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAXACTXGC

SEQ ID NO: 2840 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAXACTGXC

SEQ ID NO: 2841 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAXACTGCX

SEQ ID NO: 2842 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYXAAXCTGC

SEQ ID NO: 2843 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAAXXCTGC

SEQ ID NO: 2844 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAAXCXTGC

SEQ ID NO: 2845 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAAXCTXGC

SEQ ID NO: 2846 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAAXCTGXC

SEQ ID NO: 2847 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAAXCTGCX

SEQ ID NO: 2848 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYXAACXTGC

SEQ ID NO: 2849 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAACXXTGC

SEQ ID NO: 2850 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAACXTXGC

SEQ ID NO: 2851 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAACXTGXC

SEQ ID NO: 2852 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAACXTGCX

SEQ ID NO: 2853 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYXAACTXGC

SEQ ID NO: 2854 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAACTXXGC

SEQ ID NO: 2855 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAACTXGXC

SEQ ID NO: 2856 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAACTXGCX

SEQ ID NO: 2857 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYXAACTGXC

SEQ ID NO: 2858 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAACTGXXC

SEQ ID NO: 2859 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAACTGXCX

SEQ ID NO: 2860 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYXAACTGCX

SEQ ID NO: 2861 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYXAACTGCXX

SEQ ID NO: 2862 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCXGEICAYAXACTGC

SEQ ID NO: 2863 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAXXACTGC

SEQ ID NO: 2864 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXXXACTGC

SEQ ID NO: 2865 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXXAXCTGC

SEQ ID NO: 2866 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXXACXTGC

SEQ ID NO: 2867 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXXACTXGC

SEQ ID NO: 2868 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXXACTGXC

SEQ ID NO: 2869 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXXACTGCX

SEQ ID NO: 2870 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAXAXCTGC

SEQ ID NO: 2871 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXAXXCTGC

SEQ ID NO: 2872 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXAXCXTGC

SEQ ID NO: 2873 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXAXCTXGC

SEQ ID NO: 2874 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXAXCTGXC

SEQ ID NO: 2875 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXAXCTGCX

SEQ ID NO: 2876 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAXACXTGC

SEQ ID NO: 2877 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXACXXTGC

SEQ ID NO: 2878 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXACXTXGC

SEQ ID NO: 2879 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXACXTGXC

SEQ ID NO: 2880 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXACXTGCX

SEQ ID NO: 2881 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAXACTXGC

SEQ ID NO: 2882 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXACTXXGC

SEQ ID NO: 2883 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXACTXGXC

SEQ ID NO: 2884 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXACTXGCX

SEQ ID NO: 2885 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAXACTGXC

SEQ ID NO: 2886 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXACTGXXC

SEQ ID NO: 2887 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXACTGXCX

SEQ ID NO: 2888 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAXACTGCX

SEQ ID NO: 2889 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAXACTGCXX

SEQ ID NO: 2890 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCXGEICAYAAXCTGC

SEQ ID NO: 2891 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAAXXCTGC

SEQ ID NO: 2892 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXXXCTGC

SEQ ID NO: 2893 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXXCXTGC

SEQ ID NO: 2894 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXXCTXGC

SEQ ID NO: 2895 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXXCTGXC

SEQ ID NO: 2896 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXXCTGCX

SEQ ID NO: 2897 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAAXCXTGC

SEQ ID NO: 2898 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXCXXTGC

SEQ ID NO: 2899 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXCXTXGC

SEQ ID NO: 2900 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXCXTGXC

SEQ ID NO: 2901 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXCXTGCX

SEQ ID NO: 2902 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAAXCTXGC

SEQ ID NO: 2903 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXCTXXGC

SEQ ID NO: 2904 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXCTXGXC

SEQ ID NO: 2905 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXCTXGCX

SEQ ID NO: 2906 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAAXCTGXC

SEQ ID NO: 2907 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXCTGXXC

SEQ ID NO: 2908 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXCTGXCX

SEQ ID NO: 2909 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAAXCTGCX

SEQ ID NO: 2910 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAAXCTGCXX

SEQ ID NO: 2911 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCXGEICAYAACXTGC

SEQ ID NO: 2912 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAACXXTGC

SEQ ID NO: 2913 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACXXXTGC

SEQ ID NO: 2914 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACXXTXGC

SEQ ID NO: 2915 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACXXTGXC

SEQ ID NO: 2916 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACXXTGCX

SEQ ID NO: 2917 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAACXTXGC

SEQ ID NO: 2918 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACXTXXGC

SEQ ID NO: 2919 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACXTXGXC

SEQ ID NO: 2920 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACXTXGCX

SEQ ID NO: 2921 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAACXTGXC

SEQ ID NO: 2922 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACXTGXXC

SEQ ID NO: 2923 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACXTGXCX

SEQ ID NO: 2924 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAACXTGCX

SEQ ID NO: 2925 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACXTGCXX

SEQ ID NO: 2926 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCXGEICAYAACTXGC

SEQ ID NO: 2927 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAACTXXGC

SEQ ID NO: 2928 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACTXXXGC

SEQ ID NO: 2929 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACTXXGXC

SEQ ID NO: 2930 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACTXXGCX

SEQ ID NO: 2931 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAACTXGXC

SEQ ID NO: 2932 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACTXGXXC

SEQ ID NO: 2933 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACTXGXCX

SEQ ID NO: 2934 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAACTXGCX

SEQ ID NO: 2935 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACTXGCXX

SEQ ID NO: 2936 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCXGEICAYAACTGXC

SEQ ID NO: 2937 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAACTGXXC

SEQ ID NO: 2938 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACTGXXXC

SEQ ID NO: 2939 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACTGXXCX

SEQ ID NO: 2940 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAACTGXCX

SEQ ID NO: 2941 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACTGXCXX

SEQ ID NO: 2942 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCXGEICAYAACTGCX

SEQ ID NO: 2943 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCXGEICAYAACTGCXX

SEQ ID NO: 2944 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCXGEICAYAACTGCXXX

SEQ ID NO: 2945 - protein, 17 aa, Artificial Sequence
  Synthetically generated peptide
  VARIANT (1)...(17): Xaa = Any Amino Acid
  VARIANT (1)...(17): Xaa = Any Amino Acid
PGTCGXEICAYAACTGC

SEQ ID NO: 2946 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGXXEICAYAACTGC

SEQ ID NO: 2947 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXXXEICAYAACTGC

SEQ ID NO: 2948 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXXXEICAYAACTGC

SEQ ID NO: 2949 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXXEXICAYAACTGC

SEQ ID NO: 2950 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXXEIXCAYAACTGC

SEQ ID NO: 2951 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXXEICXAYAACTGC

SEQ ID NO: 2952 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXXEICAXYAACTGC

SEQ ID NO: 2953 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXXEICAYXAACTGC

SEQ ID NO: 2954 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXXEICAYAXACTGC

SEQ ID NO: 2955 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXXEICAYAAXCTGC

SEQ ID NO: 2956 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXXEICAYAACXTGC

SEQ ID NO: 2957 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXXEICAYAACTXGC

SEQ ID NO: 2958 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXXEICAYAACTGXC

SEQ ID NO: 2959 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXXEICAYAACTGCX

SEQ ID NO: 2960 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXXEXICAYAACTGC

SEQ ID NO: 2961 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEXXICAYAACTGC

SEQ ID NO: 2962 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEXIXCAYAACTGC

SEQ ID NO: 2963 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEXICXAYAACTGC

SEQ ID NO: 2964 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEXICAXYAACTGC

SEQ ID NO: 2965 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEXICAYXAACTGC

SEQ ID NO: 2966 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEXICAYAXACTGC

SEQ ID NO: 2967 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEXICAYAAXCTGC

SEQ ID NO: 2968 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEXICAYAACXTGC

SEQ ID NO: 2969 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEXICAYAACTXGC

SEQ ID NO: 2970 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEXICAYAACTGXC

SEQ ID NO: 2971 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEXICAYAACTGCX

SEQ ID NO: 2972 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXXEIXCAYAACTGC

SEQ ID NO: 2973 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEIXXCAYAACTGC

SEQ ID NO: 2974 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEIXCXAYAACTGC

SEQ ID NO: 2975 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEIXCAXYAACTGC

SEQ ID NO: 2976 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEIXCAYXAACTGC

SEQ ID NO: 2977 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEIXCAYAXACTGC

SEQ ID NO: 2978 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEIXCAYAAXCTGC

SEQ ID NO: 2979 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEIXCAYAACXTGC

SEQ ID NO: 2980 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEIXCAYAACTXGC

SEQ ID NO: 2981 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEIXCAYAACTGXC

SEQ ID NO: 2982 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEIXCAYAACTGCX

SEQ ID NO: 2983 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXXEICXAYAACTGC

SEQ ID NO: 2984 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICXXAYAACTGC

SEQ ID NO: 2985 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICXAXYAACTGC

SEQ ID NO: 2986 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICXAYXAACTGC

SEQ ID NO: 2987 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICXAYAXACTGC

SEQ ID NO: 2988 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICXAYAAXCTGC

SEQ ID NO: 2989 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICXAYAACXTGC

SEQ ID NO: 2990 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICXAYAACTXGC

SEQ ID NO: 2991 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICXAYAACTGXC

SEQ ID NO: 2992 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICXAYAACTGCX

SEQ ID NO: 2993 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXXEICAXYAACTGC

SEQ ID NO: 2994 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAXXYAACTGC

SEQ ID NO: 2995 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAXYXAACTGC

SEQ ID NO: 2996 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAXYAXACTGC

SEQ ID NO: 2997 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAXYAAXCTGC

SEQ ID NO: 2998 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAXYAACXTGC

SEQ ID NO: 2999 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAXYAACTXGC

SEQ ID NO: 3000 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAXYAACTGXC

SEQ ID NO: 3001 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAXYAACTGCX

SEQ ID NO: 3002 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXXEICAYXAACTGC

SEQ ID NO: 3003 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYXXAACTGC

SEQ ID NO: 3004 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYXAXACTGC

SEQ ID NO: 3005 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYXAAXCTGC

SEQ ID NO: 3006 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYXAACXTGC

SEQ ID NO: 3007 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYXAACTXGC

SEQ ID NO: 3008 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYXAACTGXC

SEQ ID NO: 3009 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYXAACTGCX

SEQ ID NO: 3010 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXXEICAYAXACTGC

SEQ ID NO: 3011 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAXXACTGC

SEQ ID NO: 3012 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAXAXCTGC

SEQ ID NO: 3013 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAXACXTGC

SEQ ID NO: 3014 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAXACTXGC

SEQ ID NO: 3015 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAXACTGXC

SEQ ID NO: 3016 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAXACTGCX

SEQ ID NO: 3017 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXXEICAYAAXCTGC

SEQ ID NO: 3018 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAAXXCTGC

SEQ ID NO: 3019 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAAXCXTGC

SEQ ID NO: 3020 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAAXCTXGC

SEQ ID NO: 3021 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAAXCTGXC

SEQ ID NO: 3022 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAAXCTGCX

SEQ ID NO: 3023 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXXEICAYAACXTGC

SEQ ID NO: 3024 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAACXXTGC

SEQ ID NO: 3025 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAACXTXGC

SEQ ID NO: 3026 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAACXTGXC

SEQ ID NO: 3027 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAACXTGCX

SEQ ID NO: 3028 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXXEICAYAACTXGC

SEQ ID NO: 3029 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAACTXXGC

SEQ ID NO: 3030 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAACTXGXC

SEQ ID NO: 3031 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAACTXGCX

SEQ ID NO: 3032 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXXEICAYAACTGXC

SEQ ID NO: 3033 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAACTGXXC

SEQ ID NO: 3034 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAACTGXCX

SEQ ID NO: 3035 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXXEICAYAACTGCX

SEQ ID NO: 3036 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXXEICAYAACTGCXX

SEQ ID NO: 3037 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGXEXICAYAACTGC

SEQ ID NO: 3038 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEXXICAYAACTGC

SEQ ID NO: 3039 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXXXICAYAACTGC

SEQ ID NO: 3040 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXXIXCAYAACTGC

SEQ ID NO: 3041 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXXICXAYAACTGC

SEQ ID NO: 3042 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXXICAXYAACTGC

SEQ ID NO: 3043 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXXICAYXAACTGC

SEQ ID NO: 3044 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXXICAYAXACTGC

SEQ ID NO: 3045 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXXICAYAAXCTGC

SEQ ID NO: 3046 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXXICAYAACXTGC

SEQ ID NO: 3047 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXXICAYAACTXGC

SEQ ID NO: 3048 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXXICAYAACTGXC

SEQ ID NO: 3049 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXXICAYAACTGCX

SEQ ID NO: 3050 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEXIXCAYAACTGC

SEQ ID NO: 3051 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXIXXCAYAACTGC

SEQ ID NO: 3052 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXIXCXAYAACTGC

SEQ ID NO: 3053 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXIXCAXYAACTGC

SEQ ID NO: 3054 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXIXCAYXAACTGC

SEQ ID NO: 3055 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXIXCAYAXACTGC

SEQ ID NO: 3056 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXIXCAYAAXCTGC

SEQ ID NO: 3057 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXIXCAYAACXTGC

SEQ ID NO: 3058 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXIXCAYAACTXGC

SEQ ID NO: 3059 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXIXCAYAACTGXC

SEQ ID NO: 3060 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXIXCAYAACTGCX

SEQ ID NO: 3061 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEXICXAYAACTGC

SEQ ID NO: 3062 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICXXAYAACTGC

SEQ ID NO: 3063 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICXAXYAACTGC

SEQ ID NO: 3064 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICXAYXAACTGC

SEQ ID NO: 3065 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICXAYAXACTGC

SEQ ID NO: 3066 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICXAYAAXCTGC

SEQ ID NO: 3067 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICXAYAACXTGC

SEQ ID NO: 3068 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICXAYAACTXGC

SEQ ID NO: 3069 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICXAYAACTGXC

SEQ ID NO: 3070 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICXAYAACTGCX

SEQ ID NO: 3071 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEXICAXYAACTGC

SEQ ID NO: 3072 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAXXYAACTGC

SEQ ID NO: 3073 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAXYXAACTGC

SEQ ID NO: 3074 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAXYAXACTGC

SEQ ID NO: 3075 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAXYAAXCTGC

SEQ ID NO: 3076 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAXYAACXTGC

SEQ ID NO: 3077 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAXYAACTXGC

SEQ ID NO: 3078 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAXYAACTGXC

SEQ ID NO: 3079 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAXYAACTGCX

SEQ ID NO: 3080 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEXICAYXAACTGC

SEQ ID NO: 3081 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYXXAACTGC

SEQ ID NO: 3082 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYXAXACTGC

SEQ ID NO: 3083 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYXAAXCTGC

SEQ ID NO: 3084 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYXAACXTGC

SEQ ID NO: 3085 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYXAACTXGC

SEQ ID NO: 3086 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYXAACTGXC

SEQ ID NO: 3087 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYXAACTGCX

SEQ ID NO: 3088 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEXICAYAXACTGC

SEQ ID NO: 3089 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAXXACTGC

SEQ ID NO: 3090 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAXAXCTGC

SEQ ID NO: 3091 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAXACXTGC

SEQ ID NO: 3092 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAXACTXGC

SEQ ID NO: 3093 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAXACTGXC

SEQ ID NO: 3094 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAXACTGCX

SEQ ID NO: 3095 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEXICAYAAXCTGC

SEQ ID NO: 3096 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAAXXCTGC

SEQ ID NO: 3097 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAAXCXTGC

SEQ ID NO: 3098 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAAXCTXGC

SEQ ID NO: 3099 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAAXCTGXC

SEQ ID NO: 3100 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAAXCTGCX

SEQ ID NO: 3101 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEXICAYAACXTGC

SEQ ID NO: 3102 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAACXXTGC

SEQ ID NO: 3103 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAACXTXGC

SEQ ID NO: 3104 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAACXTGXC

SEQ ID NO: 3105 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAACXTGCX

SEQ ID NO: 3106 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEXICAYAACTXGC

SEQ ID NO: 3107 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAACTXXGC

SEQ ID NO: 3108 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAACTXGXC

SEQ ID NO: 3109 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAACTXGCX

SEQ ID NO: 3110 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEXICAYAACTGXC

SEQ ID NO: 3111 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAACTGXXC

SEQ ID NO: 3112 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAACTGXCX

SEQ ID NO: 3113 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEXICAYAACTGCX

SEQ ID NO: 3114 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEXICAYAACTGCXX

SEQ ID NO: 3115 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGXEIXCAYAACTGC

SEQ ID NO: 3116 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEIXXCAYAACTGC

SEQ ID NO: 3117 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXXXCAYAACTGC

SEQ ID NO: 3118 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXXCXAYAACTGC

SEQ ID NO: 3119 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXXCAXYAACTGC

SEQ ID NO: 3120 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXXCAYXAACTGC

SEQ ID NO: 3121 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXXCAYAXACTGC

SEQ ID NO: 3122 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXXCAYAAXCTGC

SEQ ID NO: 3123 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXXCAYAACXTGC

SEQ ID NO: 3124 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXXCAYAACTXGC

SEQ ID NO: 3125 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXXCAYAACTGXC

SEQ ID NO: 3126 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXXCAYAACTGCX

SEQ ID NO: 3127 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEIXCXAYAACTGC

SEQ ID NO: 3128 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCXXAYAACTGC

SEQ ID NO: 3129 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCXAXYAACTGC

SEQ ID NO: 3130 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCXAYXAACTGC

SEQ ID NO: 3131 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCXAYAXACTGC

SEQ ID NO: 3132 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCXAYAAXCTGC

SEQ ID NO: 3133 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCXAYAACXTGC

SEQ ID NO: 3134 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCXAYAACTXGC

SEQ ID NO: 3135 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCXAYAACTGXC

SEQ ID NO: 3136 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCXAYAACTGCX

SEQ ID NO: 3137 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEIXCAXYAACTGC

SEQ ID NO: 3138 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAXXYAACTGC

SEQ ID NO: 3139 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAXYXAACTGC

SEQ ID NO: 3140 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAXYAXACTGC

SEQ ID NO: 3141 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAXYAAXCTGC

SEQ ID NO: 3142 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAXYAACXTGC

SEQ ID NO: 3143 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAXYAACTXGC

SEQ ID NO: 3144 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAXYAACTGXC

SEQ ID NO: 3145 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAXYAACTGCX

SEQ ID NO: 3146 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEIXCAYXAACTGC

SEQ ID NO: 3147 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYXXAACTGC

SEQ ID NO: 3148 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYXAXACTGC

SEQ ID NO: 3149 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYXAAXCTGC

SEQ ID NO: 3150 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYXAACXTGC

SEQ ID NO: 3151 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYXAACTXGC

SEQ ID NO: 3152 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYXAACTGXC

SEQ ID NO: 3153 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYXAACTGCX

SEQ ID NO: 3154 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEIXCAYAXACTGC

SEQ ID NO: 3155 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAXXACTGC

SEQ ID NO: 3156 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAXAXCTGC

SEQ ID NO: 3157 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAXACXTGC

SEQ ID NO: 3158 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAXACTXGC

SEQ ID NO: 3159 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAXACTGXC

SEQ ID NO: 3160 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAXACTGCX

SEQ ID NO: 3161 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEIXCAYAAXCTGC

SEQ ID NO: 3162 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAAXXCTGC

SEQ ID NO: 3163 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAAXCXTGC

SEQ ID NO: 3164 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAAXCTXGC

SEQ ID NO: 3165 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAAXCTGXC

SEQ ID NO: 3166 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAAXCTGCX

SEQ ID NO: 3167 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEIXCAYAACXTGC

SEQ ID NO: 3168 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAACXXTGC

SEQ ID NO: 3169 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAACXTXGC

SEQ ID NO: 3170 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAACXTGXC

SEQ ID NO: 3171 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAACXTGCX

SEQ ID NO: 3172 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEIXCAYAACTXGC

SEQ ID NO: 3173 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAACTXXGC

SEQ ID NO: 3174 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAACTXGXC

SEQ ID NO: 3175 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAACTXGCX

SEQ ID NO: 3176 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEIXCAYAACTGXC

SEQ ID NO: 3177 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAACTGXXC

SEQ ID NO: 3178 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAACTGXCX

SEQ ID NO: 3179 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEIXCAYAACTGCX

SEQ ID NO: 3180 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEIXCAYAACTGCXX

SEQ ID NO: 3181 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGXEICXAYAACTGC

SEQ ID NO: 3182 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICXXAYAACTGC

SEQ ID NO: 3183 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXXXAYAACTGC

SEQ ID NO: 3184 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXXAXYAACTGC

SEQ ID NO: 3185 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXXAYXAACTGC

SEQ ID NO: 3186 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXXAYAXACTGC

SEQ ID NO: 3187 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXXAYAAXCTGC

SEQ ID NO: 3188 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXXAYAACXTGC

SEQ ID NO: 3189 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXXAYAACTXGC

SEQ ID NO: 3190 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXXAYAACTGXC

SEQ ID NO: 3191 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXXAYAACTGCX

SEQ ID NO: 3192 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICXAXYAACTGC

SEQ ID NO: 3193 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAXXYAACTGC

SEQ ID NO: 3194 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAXYXAACTGC

SEQ ID NO: 3195 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAXYAXACTGC

SEQ ID NO: 3196 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAXYAAXCTGC

SEQ ID NO: 3197 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAXYAACXTGC

SEQ ID NO: 3198 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAXYAACTXGC

SEQ ID NO: 3199 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAXYAACTGXC

SEQ ID NO: 3200 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAXYAACTGCX

SEQ ID NO: 3201 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICXAYXAACTGC

SEQ ID NO: 3202 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYXXAACTGC

SEQ ID NO: 3203 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYXAXACTGC

SEQ ID NO: 3204 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYXAAXCTGC

SEQ ID NO: 3205 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYXAACXTGC

SEQ ID NO: 3206 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYXAACTXGC

SEQ ID NO: 3207 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYXAACTGXC

SEQ ID NO: 3208 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYXAACTGCX

SEQ ID NO: 3209 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICXAYAXACTGC

SEQ ID NO: 3210 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAXXACTGC

SEQ ID NO: 3211 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAXAXCTGC

SEQ ID NO: 3212 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAXACXTGC

SEQ ID NO: 3213 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAXACTXGC

SEQ ID NO: 3214 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAXACTGXC

SEQ ID NO: 3215 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAXACTGCX

SEQ ID NO: 3216 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICXAYAAXCTGC

SEQ ID NO: 3217 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAAXXCTGC

SEQ ID NO: 3218 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAAXCXTGC

SEQ ID NO: 3219 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAAXCTXGC

SEQ ID NO: 3220 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAAXCTGXC

SEQ ID NO: 3221 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAAXCTGCX

SEQ ID NO: 3222 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICXAYAACXTGC

SEQ ID NO: 3223 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAACXXTGC

SEQ ID NO: 3224 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAACXTXGC

SEQ ID NO: 3225 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAACXTGXC

SEQ ID NO: 3226 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAACXTGCX

SEQ ID NO: 3227 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICXAYAACTXGC

SEQ ID NO: 3228 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAACTXXGC

SEQ ID NO: 3229 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAACTXGXC

SEQ ID NO: 3230 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAACTXGCX

SEQ ID NO: 3231 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICXAYAACTGXC

SEQ ID NO: 3232 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAACTGXXC

SEQ ID NO: 3233 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAACTGXCX

SEQ ID NO: 3234 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICXAYAACTGCX

SEQ ID NO: 3235 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICXAYAACTGCXX

SEQ ID NO: 3236 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGXEICAXYAACTGC

SEQ ID NO: 3237 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAXXYAACTGC

SEQ ID NO: 3238 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXXXYAACTGC

SEQ ID NO: 3239 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXXYXAACTGC

SEQ ID NO: 3240 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXXYAXACTGC

SEQ ID NO: 3241 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXXYAAXCTGC

SEQ ID NO: 3242 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXXYAACXTGC

SEQ ID NO: 3243 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXXYAACTXGC

SEQ ID NO: 3244 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXXYAACTGXC

SEQ ID NO: 3245 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXXYAACTGCX

SEQ ID NO: 3246 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAXYXAACTGC

SEQ ID NO: 3247 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYXXAACTGC

SEQ ID NO: 3248 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYXAXACTGC

SEQ ID NO: 3249 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYXAAXCTGC

SEQ ID NO: 3250 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYXAACXTGC

SEQ ID NO: 3251 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYXAACTXGC

SEQ ID NO: 3252 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYXAACTGXC

SEQ ID NO: 3253 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYXAACTGCX

SEQ ID NO: 3254 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAXYAXACTGC

SEQ ID NO: 3255 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAXXACTGC

SEQ ID NO: 3256 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAXAXCTGC

SEQ ID NO: 3257 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAXACXTGC

SEQ ID NO: 3258 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAXACTXGC

SEQ ID NO: 3259 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAXACTGXC

SEQ ID NO: 3260 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAXACTGCX

SEQ ID NO: 3261 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAXYAAXCTGC

SEQ ID NO: 3262 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAAXXCTGC

SEQ ID NO: 3263 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAAXCXTGC

SEQ ID NO: 3264 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAAXCTXGC

SEQ ID NO: 3265 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAAXCTGXC

SEQ ID NO: 3266 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAAXCTGCX

SEQ ID NO: 3267 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAXYAACXTGC

SEQ ID NO: 3268 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAACXXTGC

SEQ ID NO: 3269 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAACXTXGC

SEQ ID NO: 3270 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAACXTGXC

SEQ ID NO: 3271 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAACXTGCX

SEQ ID NO: 3272 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAXYAACTXGC

SEQ ID NO: 3273 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAACTXXGC

SEQ ID NO: 3274 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAACTXGXC

SEQ ID NO: 3275 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAACTXGCX

SEQ ID NO: 3276 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAXYAACTGXC

SEQ ID NO: 3277 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAACTGXXC

SEQ ID NO: 3278 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAACTGXCX

SEQ ID NO: 3279 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAXYAACTGCX

SEQ ID NO: 3280 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAXYAACTGCXX

SEQ ID NO: 3281 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGXEICAYXAACTGC

SEQ ID NO: 3282 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYXXAACTGC

SEQ ID NO: 3283 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXXXAACTGC

SEQ ID NO: 3284 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXXAXACTGC

SEQ ID NO: 3285 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXXAAXCTGC

SEQ ID NO: 3286 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXXAACXTGC

SEQ ID NO: 3287 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXXAACTXGC

SEQ ID NO: 3288 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXXAACTGXC

SEQ ID NO: 3289 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXXAACTGCX

SEQ ID NO: 3290 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYXAXACTGC

SEQ ID NO: 3291 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAXXACTGC

SEQ ID NO: 3292 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAXAXCTGC

SEQ ID NO: 3293 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAXACXTGC

SEQ ID NO: 3294 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAXACTXGC

SEQ ID NO: 3295 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAXACTGXC

SEQ ID NO: 3296 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAXACTGCX

SEQ ID NO: 3297 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYXAAXCTGC

SEQ ID NO: 3298 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAAXXCTGC

SEQ ID NO: 3299 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAAXCXTGC

SEQ ID NO: 3300 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAAXCTXGC

SEQ ID NO: 3301 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAAXCTGXC

SEQ ID NO: 3302 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAAXCTGCX

SEQ ID NO: 3303 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYXAACXTGC

SEQ ID NO: 3304 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAACXXTGC

SEQ ID NO: 3305 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAACXTXGC

SEQ ID NO: 3306 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAACXTGXC

SEQ ID NO: 3307 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAACXTGCX

SEQ ID NO: 3308 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYXAACTXGC

SEQ ID NO: 3309 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAACTXXGC

SEQ ID NO: 3310 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAACTXGXC

SEQ ID NO: 3311 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAACTXGCX

SEQ ID NO: 3312 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYXAACTGXC

SEQ ID NO: 3313 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAACTGXXC

SEQ ID NO: 3314 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAACTGXCX

SEQ ID NO: 3315 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYXAACTGCX

SEQ ID NO: 3316 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYXAACTGCXX

SEQ ID NO: 3317 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGXEICAYAXACTGC

SEQ ID NO: 3318 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAXXACTGC

SEQ ID NO: 3319 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXXXACTGC

SEQ ID NO: 3320 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXXAXCTGC

SEQ ID NO: 3321 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXXACXTGC

SEQ ID NO: 3322 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXXACTXGC

SEQ ID NO: 3323 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXXACTGXC

SEQ ID NO: 3324 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXXACTGCX

SEQ ID NO: 3325 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAXAXCTGC

SEQ ID NO: 3326 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXAXXCTGC

SEQ ID NO: 3327 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXAXCXTGC

SEQ ID NO: 3328 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXAXCTXGC

SEQ ID NO: 3329 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXAXCTGXC

SEQ ID NO: 3330 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXAXCTGCX

SEQ ID NO: 3331 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAXACXTGC

SEQ ID NO: 3332 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXACXXTGC

SEQ ID NO: 3333 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXACXTXGC

SEQ ID NO: 3334 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXACXTGXC

SEQ ID NO: 3335 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXACXTGCX

SEQ ID NO: 3336 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAXACTXGC

SEQ ID NO: 3337 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXACTXXGC

SEQ ID NO: 3338 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXACTXGXC

SEQ ID NO: 3339 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXACTXGCX

SEQ ID NO: 3340 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAXACTGXC

SEQ ID NO: 3341 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXACTGXXC

SEQ ID NO: 3342 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXACTGXCX

SEQ ID NO: 3343 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAXACTGCX

SEQ ID NO: 3344 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAXACTGCXX

SEQ ID NO: 3345 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGXEICAYAAXCTGC

SEQ ID NO: 3346 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAAXXCTGC

SEQ ID NO: 3347 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXXXCTGC

SEQ ID NO: 3348 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXXCXTGC

SEQ ID NO: 3349 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXXCTXGC

SEQ ID NO: 3350 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXXCTGXC

SEQ ID NO: 3351 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXXCTGCX

SEQ ID NO: 3352 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAAXCXTGC

SEQ ID NO: 3353 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXCXXTGC

SEQ ID NO: 3354 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXCXTXGC

SEQ ID NO: 3355 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXCXTGXC

SEQ ID NO: 3356 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXCXTGCX

SEQ ID NO: 3357 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAAXCTXGC

SEQ ID NO: 3358 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXCTXXGC

SEQ ID NO: 3359 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXCTXGXC

SEQ ID NO: 3360 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXCTXGCX

SEQ ID NO: 3361 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAAXCTGXC

SEQ ID NO: 3362 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXCTGXXC

SEQ ID NO: 3363 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXCTGXCX

SEQ ID NO: 3364 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAAXCTGCX

SEQ ID NO: 3365 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAAXCTGCXX

SEQ ID NO: 3366 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGXEICAYAACXTGC

SEQ ID NO: 3367 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAACXXTGC

SEQ ID NO: 3368 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACXXXTGC

SEQ ID NO: 3369 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACXXTXGC

SEQ ID NO: 3370 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACXXTGXC

SEQ ID NO: 3371 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACXXTGCX

SEQ ID NO: 3372 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAACXTXGC

SEQ ID NO: 3373 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACXTXXGC

SEQ ID NO: 3374 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACXTXGXC

SEQ ID NO: 3375 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACXTXGCX

SEQ ID NO: 3376 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAACXTGXC

SEQ ID NO: 3377 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACXTGXXC

SEQ ID NO: 3378 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACXTGXCX

SEQ ID NO: 3379 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAACXTGCX

SEQ ID NO: 3380 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACXTGCXX

SEQ ID NO: 3381 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGXEICAYAACTXGC

SEQ ID NO: 3382 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAACTXXGC

SEQ ID NO: 3383 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACTXXXGC

SEQ ID NO: 3384 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACTXXGXC

SEQ ID NO: 3385 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACTXXGCX

SEQ ID NO: 3386 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAACTXGXC

SEQ ID NO: 3387 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACTXGXXC

SEQ ID NO: 3388 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACTXGXCX

SEQ ID NO: 3389 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAACTXGCX

SEQ ID NO: 3390 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACTXGCXX

SEQ ID NO: 3391 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGXEICAYAACTGXC

SEQ ID NO: 3392 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAACTGXXC

SEQ ID NO: 3393 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACTGXXXC

SEQ ID NO: 3394 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACTGXXCX

SEQ ID NO: 3395 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAACTGXCX

SEQ ID NO: 3396 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACTGXCXX

SEQ ID NO: 3397 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGXEICAYAACTGCX

SEQ ID NO: 3398 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGXEICAYAACTGCXX

SEQ ID NO: 3399 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGXEICAYAACTGCXXX

SEQ ID NO: 3400 - protein, 17 aa, Artificial Sequence
  Synthetically generated peptide
  VARIANT (1)...(17): Xaa = Any Amino Acid
  VARIANT (1)...(17): Xaa = Any Amino Acid
PGTCGEXICAYAACTGC

SEQ ID NO: 3401 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEXXICAYAACTGC

SEQ ID NO: 3402 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXXXICAYAACTGC

SEQ ID NO: 3403 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXXXICAYAACTGC

SEQ ID NO: 3404 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXXIXCAYAACTGC

SEQ ID NO: 3405 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXXICXAYAACTGC

SEQ ID NO: 3406 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXXICAXYAACTGC

SEQ ID NO: 3407 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXXICAYXAACTGC

SEQ ID NO: 3408 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXXICAYAXACTGC

SEQ ID NO: 3409 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXXICAYAAXCTGC

SEQ ID NO: 3410 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXXICAYAACXTGC

SEQ ID NO: 3411 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXXICAYAACTXGC

SEQ ID NO: 3412 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXXICAYAACTGXC

SEQ ID NO: 3413 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXXICAYAACTGCX

SEQ ID NO: 3414 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXXIXCAYAACTGC

SEQ ID NO: 3415 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXIXXCAYAACTGC

SEQ ID NO: 3416 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXIXCXAYAACTGC

SEQ ID NO: 3417 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXIXCAXYAACTGC

SEQ ID NO: 3418 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXIXCAYXAACTGC

SEQ ID NO: 3419 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXIXCAYAXACTGC

SEQ ID NO: 3420 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXIXCAYAAXCTGC

SEQ ID NO: 3421 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXIXCAYAACXTGC

SEQ ID NO: 3422 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXIXCAYAACTXGC

SEQ ID NO: 3423 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXIXCAYAACTGXC

SEQ ID NO: 3424 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXIXCAYAACTGCX

SEQ ID NO: 3425 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXXICXAYAACTGC

SEQ ID NO: 3426 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICXXAYAACTGC

SEQ ID NO: 3427 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICXAXYAACTGC

SEQ ID NO: 3428 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICXAYXAACTGC

SEQ ID NO: 3429 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICXAYAXACTGC

SEQ ID NO: 3430 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICXAYAAXCTGC

SEQ ID NO: 3431 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICXAYAACXTGC

SEQ ID NO: 3432 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICXAYAACTXGC

SEQ ID NO: 3433 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICXAYAACTGXC

SEQ ID NO: 3434 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICXAYAACTGCX

SEQ ID NO: 3435 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXXICAXYAACTGC

SEQ ID NO: 3436 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAXXYAACTGC

SEQ ID NO: 3437 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAXYXAACTGC

SEQ ID NO: 3438 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAXYAXACTGC

SEQ ID NO: 3439 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAXYAAXCTGC

SEQ ID NO: 3440 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAXYAACXTGC

SEQ ID NO: 3441 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAXYAACTXGC

SEQ ID NO: 3442 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAXYAACTGXC

SEQ ID NO: 3443 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAXYAACTGCX

SEQ ID NO: 3444 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXXICAYXAACTGC

SEQ ID NO: 3445 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYXXAACTGC

SEQ ID NO: 3446 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYXAXACTGC

SEQ ID NO: 3447 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYXAAXCTGC

SEQ ID NO: 3448 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYXAACXTGC

SEQ ID NO: 3449 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYXAACTXGC

SEQ ID NO: 3450 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYXAACTGXC

SEQ ID NO: 3451 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYXAACTGCX

SEQ ID NO: 3452 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXXICAYAXACTGC

SEQ ID NO: 3453 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAXXACTGC

SEQ ID NO: 3454 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAXAXCTGC

SEQ ID NO: 3455 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAXACXTGC

SEQ ID NO: 3456 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAXACTXGC

SEQ ID NO: 3457 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAXACTGXC

SEQ ID NO: 3458 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAXACTGCX

SEQ ID NO: 3459 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXXICAYAAXCTGC

SEQ ID NO: 3460 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAAXXCTGC

SEQ ID NO: 3461 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAAXCXTGC

SEQ ID NO: 3462 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAAXCTXGC

SEQ ID NO: 3463 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAAXCTGXC

SEQ ID NO: 3464 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAAXCTGCX

SEQ ID NO: 3465 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXXICAYAACXTGC

SEQ ID NO: 3466 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAACXXTGC

SEQ ID NO: 3467 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAACXTXGC

SEQ ID NO: 3468 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAACXTGXC

SEQ ID NO: 3469 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAACXTGCX

SEQ ID NO: 3470 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXXICAYAACTXGC

SEQ ID NO: 3471 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAACTXXGC

SEQ ID NO: 3472 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAACTXGXC

SEQ ID NO: 3473 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAACTXGCX

SEQ ID NO: 3474 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXXICAYAACTGXC

SEQ ID NO: 3475 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAACTGXXC

SEQ ID NO: 3476 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAACTGXCX

SEQ ID NO: 3477 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXXICAYAACTGCX

SEQ ID NO: 3478 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXXICAYAACTGCXX

SEQ ID NO: 3479 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEXIXCAYAACTGC

SEQ ID NO: 3480 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXIXXCAYAACTGC

SEQ ID NO: 3481 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXXXCAYAACTGC

SEQ ID NO: 3482 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXXCXAYAACTGC

SEQ ID NO: 3483 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXXCAXYAACTGC

SEQ ID NO: 3484 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXXCAYXAACTGC

SEQ ID NO: 3485 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXXCAYAXACTGC

SEQ ID NO: 3486 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXXCAYAAXCTGC

SEQ ID NO: 3487 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXXCAYAACXTGC

SEQ ID NO: 3488 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXXCAYAACTXGC

SEQ ID NO: 3489 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXXCAYAACTGXC

SEQ ID NO: 3490 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXXCAYAACTGCX

SEQ ID NO: 3491 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXIXCXAYAACTGC

SEQ ID NO: 3492 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCXXAYAACTGC

SEQ ID NO: 3493 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCXAXYAACTGC

SEQ ID NO: 3494 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCXAYXAACTGC

SEQ ID NO: 3495 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCXAYAXACTGC

SEQ ID NO: 3496 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCXAYAAXCTGC

SEQ ID NO: 3497 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCXAYAACXTGC

SEQ ID NO: 3498 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCXAYAACTXGC

SEQ ID NO: 3499 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCXAYAACTGXC

SEQ ID NO: 3500 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCXAYAACTGCX

SEQ ID NO: 3501 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXIXCAXYAACTGC

SEQ ID NO: 3502 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAXXYAACTGC

SEQ ID NO: 3503 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAXYXAACTGC

SEQ ID NO: 3504 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAXYAXACTGC

SEQ ID NO: 3505 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAXYAAXCTGC

SEQ ID NO: 3506 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAXYAACXTGC

SEQ ID NO: 3507 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAXYAACTXGC

SEQ ID NO: 3508 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAXYAACTGXC

SEQ ID NO: 3509 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAXYAACTGCX

SEQ ID NO: 3510 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXIXCAYXAACTGC

SEQ ID NO: 3511 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYXXAACTGC

SEQ ID NO: 3512 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYXAXACTGC

SEQ ID NO: 3513 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYXAAXCTGC

SEQ ID NO: 3514 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYXAACXTGC

SEQ ID NO: 3515 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYXAACTXGC

SEQ ID NO: 3516 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYXAACTGXC

SEQ ID NO: 3517 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYXAACTGCX

SEQ ID NO: 3518 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXIXCAYAXACTGC

SEQ ID NO: 3519 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAXXACTGC

SEQ ID NO: 3520 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAXAXCTGC

SEQ ID NO: 3521 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAXACXTGC

SEQ ID NO: 3522 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAXACTXGC

SEQ ID NO: 3523 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAXACTGXC

SEQ ID NO: 3524 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAXACTGCX

SEQ ID NO: 3525 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXIXCAYAAXCTGC

SEQ ID NO: 3526 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAAXXCTGC

SEQ ID NO: 3527 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAAXCXTGC

SEQ ID NO: 3528 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAAXCTXGC

SEQ ID NO: 3529 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAAXCTGXC

SEQ ID NO: 3530 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAAXCTGCX

SEQ ID NO: 3531 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXIXCAYAACXTGC

SEQ ID NO: 3532 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAACXXTGC

SEQ ID NO: 3533 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAACXTXGC

SEQ ID NO: 3534 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAACXTGXC

SEQ ID NO: 3535 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAACXTGCX

SEQ ID NO: 3536 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXIXCAYAACTXGC

SEQ ID NO: 3537 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAACTXXGC

SEQ ID NO: 3538 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAACTXGXC

SEQ ID NO: 3539 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAACTXGCX

SEQ ID NO: 3540 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXIXCAYAACTGXC

SEQ ID NO: 3541 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAACTGXXC

SEQ ID NO: 3542 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAACTGXCX

SEQ ID NO: 3543 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXIXCAYAACTGCX

SEQ ID NO: 3544 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXIXCAYAACTGCXX

SEQ ID NO: 3545 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEXICXAYAACTGC

SEQ ID NO: 3546 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICXXAYAACTGC

SEQ ID NO: 3547 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXXXAYAACTGC

SEQ ID NO: 3548 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXXAXYAACTGC

SEQ ID NO: 3549 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXXAYXAACTGC

SEQ ID NO: 3550 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXXAYAXACTGC

SEQ ID NO: 3551 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXXAYAAXCTGC

SEQ ID NO: 3552 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXXAYAACXTGC

SEQ ID NO: 3553 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXXAYAACTXGC

SEQ ID NO: 3554 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXXAYAACTGXC

SEQ ID NO: 3555 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXXAYAACTGCX

SEQ ID NO: 3556 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICXAXYAACTGC

SEQ ID NO: 3557 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAXXYAACTGC

SEQ ID NO: 3558 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAXYXAACTGC

SEQ ID NO: 3559 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAXYAXACTGC

SEQ ID NO: 3560 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAXYAAXCTGC

SEQ ID NO: 3561 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAXYAACXTGC

SEQ ID NO: 3562 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAXYAACTXGC

SEQ ID NO: 3563 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAXYAACTGXC

SEQ ID NO: 3564 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAXYAACTGCX

SEQ ID NO: 3565 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICXAYXAACTGC

SEQ ID NO: 3566 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYXXAACTGC

SEQ ID NO: 3567 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYXAXACTGC

SEQ ID NO: 3568 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYXAAXCTGC

SEQ ID NO: 3569 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYXAACXTGC

SEQ ID NO: 3570 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYXAACTXGC

SEQ ID NO: 3571 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYXAACTGXC

SEQ ID NO: 3572 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYXAACTGCX

SEQ ID NO: 3573 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICXAYAXACTGC

SEQ ID NO: 3574 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAXXACTGC

SEQ ID NO: 3575 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAXAXCTGC

SEQ ID NO: 3576 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAXACXTGC

SEQ ID NO: 3577 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAXACTXGC

SEQ ID NO: 3578 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAXACTGXC

SEQ ID NO: 3579 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAXACTGCX

SEQ ID NO: 3580 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICXAYAAXCTGC

SEQ ID NO: 3581 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAAXXCTGC

SEQ ID NO: 3582 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAAXCXTGC

SEQ ID NO: 3583 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAAXCTXGC

SEQ ID NO: 3584 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAAXCTGXC

SEQ ID NO: 3585 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAAXCTGCX

SEQ ID NO: 3586 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICXAYAACXTGC

SEQ ID NO: 3587 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAACXXTGC

SEQ ID NO: 3588 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAACXTXGC

SEQ ID NO: 3589 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAACXTGXC

SEQ ID NO: 3590 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAACXTGCX

SEQ ID NO: 3591 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICXAYAACTXGC

SEQ ID NO: 3592 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAACTXXGC

SEQ ID NO: 3593 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAACTXGXC

SEQ ID NO: 3594 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAACTXGCX

SEQ ID NO: 3595 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICXAYAACTGXC

SEQ ID NO: 3596 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAACTGXXC

SEQ ID NO: 3597 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAACTGXCX

SEQ ID NO: 3598 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICXAYAACTGCX

SEQ ID NO: 3599 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICXAYAACTGCXX

SEQ ID NO: 3600 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEXICAXYAACTGC

SEQ ID NO: 3601 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAXXYAACTGC

SEQ ID NO: 3602 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXXXYAACTGC

SEQ ID NO: 3603 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXXYXAACTGC

SEQ ID NO: 3604 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXXYAXACTGC

SEQ ID NO: 3605 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXXYAAXCTGC

SEQ ID NO: 3606 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXXYAACXTGC

SEQ ID NO: 3607 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXXYAACTXGC

SEQ ID NO: 3608 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXXYAACTGXC

SEQ ID NO: 3609 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXXYAACTGCX

SEQ ID NO: 3610 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAXYXAACTGC

SEQ ID NO: 3611 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYXXAACTGC

SEQ ID NO: 3612 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYXAXACTGC

SEQ ID NO: 3613 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYXAAXCTGC

SEQ ID NO: 3614 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYXAACXTGC

SEQ ID NO: 3615 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYXAACTXGC

SEQ ID NO: 3616 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYXAACTGXC

SEQ ID NO: 3617 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYXAACTGCX

SEQ ID NO: 3618 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAXYAXACTGC

SEQ ID NO: 3619 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAXXACTGC

SEQ ID NO: 3620 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAXAXCTGC

SEQ ID NO: 3621 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAXACXTGC

SEQ ID NO: 3622 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAXACTXGC

SEQ ID NO: 3623 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAXACTGXC

SEQ ID NO: 3624 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAXACTGCX

SEQ ID NO: 3625 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAXYAAXCTGC

SEQ ID NO: 3626 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAAXXCTGC

SEQ ID NO: 3627 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAAXCXTGC

SEQ ID NO: 3628 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAAXCTXGC

SEQ ID NO: 3629 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAAXCTGXC

SEQ ID NO: 3630 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAAXCTGCX

SEQ ID NO: 3631 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAXYAACXTGC

SEQ ID NO: 3632 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAACXXTGC

SEQ ID NO: 3633 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAACXTXGC

SEQ ID NO: 3634 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAACXTGXC

SEQ ID NO: 3635 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAACXTGCX

SEQ ID NO: 3636 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAXYAACTXGC

SEQ ID NO: 3637 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAACTXXGC

SEQ ID NO: 3638 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAACTXGXC

SEQ ID NO: 3639 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAACTXGCX

SEQ ID NO: 3640 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAXYAACTGXC

SEQ ID NO: 3641 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAACTGXXC

SEQ ID NO: 3642 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAACTGXCX

SEQ ID NO: 3643 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAXYAACTGCX

SEQ ID NO: 3644 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAXYAACTGCXX

SEQ ID NO: 3645 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEXICAYXAACTGC

SEQ ID NO: 3646 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYXXAACTGC

SEQ ID NO: 3647 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXXXAACTGC

SEQ ID NO: 3648 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXXAXACTGC

SEQ ID NO: 3649 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXXAAXCTGC

SEQ ID NO: 3650 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXXAACXTGC

SEQ ID NO: 3651 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXXAACTXGC

SEQ ID NO: 3652 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXXAACTGXC

SEQ ID NO: 3653 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXXAACTGCX

SEQ ID NO: 3654 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYXAXACTGC

SEQ ID NO: 3655 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAXXACTGC

SEQ ID NO: 3656 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAXAXCTGC

SEQ ID NO: 3657 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAXACXTGC

SEQ ID NO: 3658 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAXACTXGC

SEQ ID NO: 3659 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAXACTGXC

SEQ ID NO: 3660 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAXACTGCX

SEQ ID NO: 3661 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYXAAXCTGC

SEQ ID NO: 3662 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAAXXCTGC

SEQ ID NO: 3663 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAAXCXTGC

SEQ ID NO: 3664 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAAXCTXGC

SEQ ID NO: 3665 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAAXCTGXC

SEQ ID NO: 3666 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAAXCTGCX

SEQ ID NO: 3667 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYXAACXTGC

SEQ ID NO: 3668 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAACXXTGC

SEQ ID NO: 3669 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAACXTXGC

SEQ ID NO: 3670 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAACXTGXC

SEQ ID NO: 3671 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAACXTGCX

SEQ ID NO: 3672 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYXAACTXGC

SEQ ID NO: 3673 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAACTXXGC

SEQ ID NO: 3674 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAACTXGXC

SEQ ID NO: 3675 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAACTXGCX

SEQ ID NO: 3676 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYXAACTGXC

SEQ ID NO: 3677 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAACTGXXC

SEQ ID NO: 3678 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAACTGXCX

SEQ ID NO: 3679 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYXAACTGCX

SEQ ID NO: 3680 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYXAACTGCXX

SEQ ID NO: 3681 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEXICAYAXACTGC

SEQ ID NO: 3682 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAXXACTGC

SEQ ID NO: 3683 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXXXACTGC

SEQ ID NO: 3684 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXXAXCTGC

SEQ ID NO: 3685 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXXACXTGC

SEQ ID NO: 3686 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXXACTXGC

SEQ ID NO: 3687 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXXACTGXC

SEQ ID NO: 3688 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXXACTGCX

SEQ ID NO: 3689 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAXAXCTGC

SEQ ID NO: 3690 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXAXXCTGC

SEQ ID NO: 3691 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXAXCXTGC

SEQ ID NO: 3692 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXAXCTXGC

SEQ ID NO: 3693 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXAXCTGXC

SEQ ID NO: 3694 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXAXCTGCX

SEQ ID NO: 3695 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAXACXTGC

SEQ ID NO: 3696 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXACXXTGC

SEQ ID NO: 3697 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXACXTXGC

SEQ ID NO: 3698 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXACXTGXC

SEQ ID NO: 3699 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXACXTGCX

SEQ ID NO: 3700 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAXACTXGC

SEQ ID NO: 3701 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXACTXXGC

SEQ ID NO: 3702 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXACTXGXC

SEQ ID NO: 3703 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXACTXGCX

SEQ ID NO: 3704 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAXACTGXC

SEQ ID NO: 3705 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXACTGXXC

SEQ ID NO: 3706 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXACTGXCX

SEQ ID NO: 3707 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAXACTGCX

SEQ ID NO: 3708 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAXACTGCXX

SEQ ID NO: 3709 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEXICAYAAXCTGC

SEQ ID NO: 3710 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAAXXCTGC

SEQ ID NO: 3711 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXXXCTGC

SEQ ID NO: 3712 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXXCXTGC

SEQ ID NO: 3713 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXXCTXGC

SEQ ID NO: 3714 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXXCTGXC

SEQ ID NO: 3715 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXXCTGCX

SEQ ID NO: 3716 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAAXCXTGC

SEQ ID NO: 3717 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXCXXTGC

SEQ ID NO: 3718 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXCXTXGC

SEQ ID NO: 3719 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXCXTGXC

SEQ ID NO: 3720 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXCXTGCX

SEQ ID NO: 3721 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAAXCTXGC

SEQ ID NO: 3722 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXCTXXGC

SEQ ID NO: 3723 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXCTXGXC

SEQ ID NO: 3724 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXCTXGCX

SEQ ID NO: 3725 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAAXCTGXC

SEQ ID NO: 3726 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXCTGXXC

SEQ ID NO: 3727 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXCTGXCX

SEQ ID NO: 3728 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAAXCTGCX

SEQ ID NO: 3729 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAAXCTGCXX

SEQ ID NO: 3730 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEXICAYAACXTGC

SEQ ID NO: 3731 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAACXXTGC

SEQ ID NO: 3732 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACXXXTGC

SEQ ID NO: 3733 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACXXTXGC

SEQ ID NO: 3734 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACXXTGXC

SEQ ID NO: 3735 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACXXTGCX

SEQ ID NO: 3736 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAACXTXGC

SEQ ID NO: 3737 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACXTXXGC

SEQ ID NO: 3738 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACXTXGXC

SEQ ID NO: 3739 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACXTXGCX

SEQ ID NO: 3740 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAACXTGXC

SEQ ID NO: 3741 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACXTGXXC

SEQ ID NO: 3742 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACXTGXCX

SEQ ID NO: 3743 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAACXTGCX

SEQ ID NO: 3744 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACXTGCXX

SEQ ID NO: 3745 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEXICAYAACTXGC

SEQ ID NO: 3746 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAACTXXGC

SEQ ID NO: 3747 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACTXXXGC

SEQ ID NO: 3748 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACTXXGXC

SEQ ID NO: 3749 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACTXXGCX

SEQ ID NO: 3750 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAACTXGXC

SEQ ID NO: 3751 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACTXGXXC

SEQ ID NO: 3752 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACTXGXCX

SEQ ID NO: 3753 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAACTXGCX

SEQ ID NO: 3754 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACTXGCXX

SEQ ID NO: 3755 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEXICAYAACTGXC

SEQ ID NO: 3756 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAACTGXXC

SEQ ID NO: 3757 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACTGXXXC

SEQ ID NO: 3758 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACTGXXCX

SEQ ID NO: 3759 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAACTGXCX

SEQ ID NO: 3760 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACTGXCXX

SEQ ID NO: 3761 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEXICAYAACTGCX

SEQ ID NO: 3762 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEXICAYAACTGCXX

SEQ ID NO: 3763 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEXICAYAACTGCXXX

SEQ ID NO: 3764 - protein, 17 aa, Artificial Sequence
  Synthetically generated peptide
  VARIANT (1)...(17): Xaa = Any Amino Acid
  VARIANT (1)...(17): Xaa = Any Amino Acid
PGTCGEIXCAYAACTGC

SEQ ID NO: 3765 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEIXXCAYAACTGC

SEQ ID NO: 3766 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXXXCAYAACTGC

SEQ ID NO: 3767 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXXXCAYAACTGC

SEQ ID NO: 3768 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXXCXAYAACTGC

SEQ ID NO: 3769 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXXCAXYAACTGC

SEQ ID NO: 3770 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXXCAYXAACTGC

SEQ ID NO: 3771 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXXCAYAXACTGC

SEQ ID NO: 3772 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXXCAYAAXCTGC

SEQ ID NO: 3773 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXXCAYAACXTGC

SEQ ID NO: 3774 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXXCAYAACTXGC

SEQ ID NO: 3775 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXXCAYAACTGXC

SEQ ID NO: 3776 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXXCAYAACTGCX

SEQ ID NO: 3777 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXXCXAYAACTGC

SEQ ID NO: 3778 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCXXAYAACTGC

SEQ ID NO: 3779 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCXAXYAACTGC

SEQ ID NO: 3780 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCXAYXAACTGC

SEQ ID NO: 3781 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCXAYAXACTGC

SEQ ID NO: 3782 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCXAYAAXCTGC

SEQ ID NO: 3783 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCXAYAACXTGC

SEQ ID NO: 3784 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCXAYAACTXGC

SEQ ID NO: 3785 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCXAYAACTGXC

SEQ ID NO: 3786 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCXAYAACTGCX

SEQ ID NO: 3787 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXXCAXYAACTGC

SEQ ID NO: 3788 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAXXYAACTGC

SEQ ID NO: 3789 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAXYXAACTGC

SEQ ID NO: 3790 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAXYAXACTGC

SEQ ID NO: 3791 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAXYAAXCTGC

SEQ ID NO: 3792 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAXYAACXTGC

SEQ ID NO: 3793 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAXYAACTXGC

SEQ ID NO: 3794 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAXYAACTGXC

SEQ ID NO: 3795 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAXYAACTGCX

SEQ ID NO: 3796 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXXCAYXAACTGC

SEQ ID NO: 3797 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYXXAACTGC

SEQ ID NO: 3798 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYXAXACTGC

SEQ ID NO: 3799 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYXAAXCTGC

SEQ ID NO: 3800 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYXAACXTGC

SEQ ID NO: 3801 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYXAACTXGC

SEQ ID NO: 3802 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYXAACTGXC

SEQ ID NO: 3803 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYXAACTGCX

SEQ ID NO: 3804 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXXCAYAXACTGC

SEQ ID NO: 3805 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAXXACTGC

SEQ ID NO: 3806 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAXAXCTGC

SEQ ID NO: 3807 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAXACXTGC

SEQ ID NO: 3808 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAXACTXGC

SEQ ID NO: 3809 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAXACTGXC

SEQ ID NO: 3810 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAXACTGCX

SEQ ID NO: 3811 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXXCAYAAXCTGC

SEQ ID NO: 3812 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAAXXCTGC

SEQ ID NO: 3813 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAAXCXTGC

SEQ ID NO: 3814 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAAXCTXGC

SEQ ID NO: 3815 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAAXCTGXC

SEQ ID NO: 3816 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAAXCTGCX

SEQ ID NO: 3817 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXXCAYAACXTGC

SEQ ID NO: 3818 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAACXXTGC

SEQ ID NO: 3819 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAACXTXGC

SEQ ID NO: 3820 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAACXTGXC

SEQ ID NO: 3821 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAACXTGCX

SEQ ID NO: 3822 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXXCAYAACTXGC

SEQ ID NO: 3823 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAACTXXGC

SEQ ID NO: 3824 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAACTXGXC

SEQ ID NO: 3825 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAACTXGCX

SEQ ID NO: 3826 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXXCAYAACTGXC

SEQ ID NO: 3827 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAACTGXXC

SEQ ID NO: 3828 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAACTGXCX

SEQ ID NO: 3829 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXXCAYAACTGCX

SEQ ID NO: 3830 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXXCAYAACTGCXX

SEQ ID NO: 3831 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEIXCXAYAACTGC

SEQ ID NO: 3832 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCXXAYAACTGC

SEQ ID NO: 3833 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXXXAYAACTGC

SEQ ID NO: 3834 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXXAXYAACTGC

SEQ ID NO: 3835 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXXAYXAACTGC

SEQ ID NO: 3836 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXXAYAXACTGC

SEQ ID NO: 3837 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXXAYAAXCTGC

SEQ ID NO: 3838 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXXAYAACXTGC

SEQ ID NO: 3839 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXXAYAACTXGC

SEQ ID NO: 3840 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXXAYAACTGXC

SEQ ID NO: 3841 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXXAYAACTGCX

SEQ ID NO: 3842 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCXAXYAACTGC

SEQ ID NO: 3843 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAXXYAACTGC

SEQ ID NO: 3844 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAXYXAACTGC

SEQ ID NO: 3845 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAXYAXACTGC

SEQ ID NO: 3846 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAXYAAXCTGC

SEQ ID NO: 3847 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAXYAACXTGC

SEQ ID NO: 3848 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAXYAACTXGC

SEQ ID NO: 3849 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAXYAACTGXC

SEQ ID NO: 3850 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAXYAACTGCX

SEQ ID NO: 3851 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCXAYXAACTGC

SEQ ID NO: 3852 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYXXAACTGC

SEQ ID NO: 3853 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYXAXACTGC

SEQ ID NO: 3854 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYXAAXCTGC

SEQ ID NO: 3855 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYXAACXTGC

SEQ ID NO: 3856 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYXAACTXGC

SEQ ID NO: 3857 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYXAACTGXC

SEQ ID NO: 3858 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYXAACTGCX

SEQ ID NO: 3859 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCXAYAXACTGC

SEQ ID NO: 3860 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAXXACTGC

SEQ ID NO: 3861 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAXAXCTGC

SEQ ID NO: 3862 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAXACXTGC

SEQ ID NO: 3863 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAXACTXGC

SEQ ID NO: 3864 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAXACTGXC

SEQ ID NO: 3865 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAXACTGCX

SEQ ID NO: 3866 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCXAYAAXCTGC

SEQ ID NO: 3867 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAAXXCTGC

SEQ ID NO: 3868 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAAXCXTGC

SEQ ID NO: 3869 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAAXCTXGC

SEQ ID NO: 3870 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAAXCTGXC

SEQ ID NO: 3871 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAAXCTGCX

SEQ ID NO: 3872 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCXAYAACXTGC

SEQ ID NO: 3873 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAACXXTGC

SEQ ID NO: 3874 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAACXTXGC

SEQ ID NO: 3875 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAACXTGXC

SEQ ID NO: 3876 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAACXTGCX

SEQ ID NO: 3877 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCXAYAACTXGC

SEQ ID NO: 3878 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAACTXXGC

SEQ ID NO: 3879 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAACTXGXC

SEQ ID NO: 3880 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAACTXGCX

SEQ ID NO: 3881 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCXAYAACTGXC

SEQ ID NO: 3882 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAACTGXXC

SEQ ID NO: 3883 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAACTGXCX

SEQ ID NO: 3884 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCXAYAACTGCX

SEQ ID NO: 3885 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCXAYAACTGCXX

SEQ ID NO: 3886 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEIXCAXYAACTGC

SEQ ID NO: 3887 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAXXYAACTGC

SEQ ID NO: 3888 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXXXYAACTGC

SEQ ID NO: 3889 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXXYXAACTGC

SEQ ID NO: 3890 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXXYAXACTGC

SEQ ID NO: 3891 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXXYAAXCTGC

SEQ ID NO: 3892 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXXYAACXTGC

SEQ ID NO: 3893 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXXYAACTXGC

SEQ ID NO: 3894 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXXYAACTGXC

SEQ ID NO: 3895 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXXYAACTGCX

SEQ ID NO: 3896 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAXYXAACTGC

SEQ ID NO: 3897 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYXXAACTGC

SEQ ID NO: 3898 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYXAXACTGC

SEQ ID NO: 3899 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYXAAXCTGC

SEQ ID NO: 3900 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYXAACXTGC

SEQ ID NO: 3901 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYXAACTXGC

SEQ ID NO: 3902 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYXAACTGXC

SEQ ID NO: 3903 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYXAACTGCX

SEQ ID NO: 3904 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAXYAXACTGC

SEQ ID NO: 3905 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAXXACTGC

SEQ ID NO: 3906 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAXAXCTGC

SEQ ID NO: 3907 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAXACXTGC

SEQ ID NO: 3908 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAXACTXGC

SEQ ID NO: 3909 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAXACTGXC

SEQ ID NO: 3910 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAXACTGCX

SEQ ID NO: 3911 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAXYAAXCTGC

SEQ ID NO: 3912 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAAXXCTGC

SEQ ID NO: 3913 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAAXCXTGC

SEQ ID NO: 3914 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAAXCTXGC

SEQ ID NO: 3915 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAAXCTGXC

SEQ ID NO: 3916 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAAXCTGCX

SEQ ID NO: 3917 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAXYAACXTGC

SEQ ID NO: 3918 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAACXXTGC

SEQ ID NO: 3919 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAACXTXGC

SEQ ID NO: 3920 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAACXTGXC

SEQ ID NO: 3921 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAACXTGCX

SEQ ID NO: 3922 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAXYAACTXGC

SEQ ID NO: 3923 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAACTXXGC

SEQ ID NO: 3924 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAACTXGXC

SEQ ID NO: 3925 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAACTXGCX

SEQ ID NO: 3926 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAXYAACTGXC

SEQ ID NO: 3927 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAACTGXXC

SEQ ID NO: 3928 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAACTGXCX

SEQ ID NO: 3929 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAXYAACTGCX

SEQ ID NO: 3930 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAXYAACTGCXX

SEQ ID NO: 3931 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEIXCAYXAACTGC

SEQ ID NO: 3932 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYXXAACTGC

SEQ ID NO: 3933 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXXXAACTGC

SEQ ID NO: 3934 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXXAXACTGC

SEQ ID NO: 3935 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXXAAXCTGC

SEQ ID NO: 3936 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXXAACXTGC

SEQ ID NO: 3937 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXXAACTXGC

SEQ ID NO: 3938 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXXAACTGXC

SEQ ID NO: 3939 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXXAACTGCX

SEQ ID NO: 3940 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYXAXACTGC

SEQ ID NO: 3941 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAXXACTGC

SEQ ID NO: 3942 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAXAXCTGC

SEQ ID NO: 3943 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAXACXTGC

SEQ ID NO: 3944 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAXACTXGC

SEQ ID NO: 3945 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAXACTGXC

SEQ ID NO: 3946 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAXACTGCX

SEQ ID NO: 3947 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYXAAXCTGC

SEQ ID NO: 3948 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAAXXCTGC

SEQ ID NO: 3949 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAAXCXTGC

SEQ ID NO: 3950 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAAXCTXGC

SEQ ID NO: 3951 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAAXCTGXC

SEQ ID NO: 3952 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAAXCTGCX

SEQ ID NO: 3953 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYXAACXTGC

SEQ ID NO: 3954 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAACXXTGC

SEQ ID NO: 3955 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAACXTXGC

SEQ ID NO: 3956 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAACXTGXC

SEQ ID NO: 3957 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAACXTGCX

SEQ ID NO: 3958 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYXAACTXGC

SEQ ID NO: 3959 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAACTXXGC

SEQ ID NO: 3960 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAACTXGXC

SEQ ID NO: 3961 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAACTXGCX

SEQ ID NO: 3962 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYXAACTGXC

SEQ ID NO: 3963 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAACTGXXC

SEQ ID NO: 3964 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAACTGXCX

SEQ ID NO: 3965 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYXAACTGCX

SEQ ID NO: 3966 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYXAACTGCXX

SEQ ID NO: 3967 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEIXCAYAXACTGC

SEQ ID NO: 3968 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAXXACTGC

SEQ ID NO: 3969 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXXXACTGC

SEQ ID NO: 3970 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXXAXCTGC

SEQ ID NO: 3971 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXXACXTGC

SEQ ID NO: 3972 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXXACTXGC

SEQ ID NO: 3973 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXXACTGXC

SEQ ID NO: 3974 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXXACTGCX

SEQ ID NO: 3975 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAXAXCTGC

SEQ ID NO: 3976 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXAXXCTGC

SEQ ID NO: 3977 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXAXCXTGC

SEQ ID NO: 3978 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXAXCTXGC

SEQ ID NO: 3979 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXAXCTGXC

SEQ ID NO: 3980 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXAXCTGCX

SEQ ID NO: 3981 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAXACXTGC

SEQ ID NO: 3982 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXACXXTGC

SEQ ID NO: 3983 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXACXTXGC

SEQ ID NO: 3984 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXACXTGXC

SEQ ID NO: 3985 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXACXTGCX

SEQ ID NO: 3986 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAXACTXGC

SEQ ID NO: 3987 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXACTXXGC

SEQ ID NO: 3988 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXACTXGXC

SEQ ID NO: 3989 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXACTXGCX

SEQ ID NO: 3990 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAXACTGXC

SEQ ID NO: 3991 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXACTGXXC

SEQ ID NO: 3992 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXACTGXCX

SEQ ID NO: 3993 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAXACTGCX

SEQ ID NO: 3994 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAXACTGCXX

SEQ ID NO: 3995 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEIXCAYAAXCTGC

SEQ ID NO: 3996 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAAXXCTGC

SEQ ID NO: 3997 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXXXCTGC

SEQ ID NO: 3998 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXXCXTGC

SEQ ID NO: 3999 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXXCTXGC

SEQ ID NO: 4000 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXXCTGXC

SEQ ID NO: 4001 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXXCTGCX

SEQ ID NO: 4002 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAAXCXTGC

SEQ ID NO: 4003 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXCXXTGC

SEQ ID NO: 4004 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXCXTXGC

SEQ ID NO: 4005 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXCXTGXC

SEQ ID NO: 4006 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXCXTGCX

SEQ ID NO: 4007 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAAXCTXGC

SEQ ID NO: 4008 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXCTXXGC

SEQ ID NO: 4009 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXCTXGXC

SEQ ID NO: 4010 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXCTXGCX

SEQ ID NO: 4011 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAAXCTGXC

SEQ ID NO: 4012 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXCTGXXC

SEQ ID NO: 4013 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXCTGXCX

SEQ ID NO: 4014 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAAXCTGCX

SEQ ID NO: 4015 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAAXCTGCXX

SEQ ID NO: 4016 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEIXCAYAACXTGC

SEQ ID NO: 4017 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAACXXTGC

SEQ ID NO: 4018 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACXXXTGC

SEQ ID NO: 4019 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACXXTXGC

SEQ ID NO: 4020 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACXXTGXC

SEQ ID NO: 4021 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACXXTGCX

SEQ ID NO: 4022 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAACXTXGC

SEQ ID NO: 4023 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACXTXXGC

SEQ ID NO: 4024 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACXTXGXC

SEQ ID NO: 4025 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACXTXGCX

SEQ ID NO: 4026 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAACXTGXC

SEQ ID NO: 4027 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACXTGXXC

SEQ ID NO: 4028 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACXTGXCX

SEQ ID NO: 4029 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAACXTGCX

SEQ ID NO: 4030 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACXTGCXX

SEQ ID NO: 4031 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEIXCAYAACTXGC

SEQ ID NO: 4032 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAACTXXGC

SEQ ID NO: 4033 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACTXXXGC

SEQ ID NO: 4034 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACTXXGXC

SEQ ID NO: 4035 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACTXXGCX

SEQ ID NO: 4036 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAACTXGXC

SEQ ID NO: 4037 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACTXGXXC

SEQ ID NO: 4038 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACTXGXCX

SEQ ID NO: 4039 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAACTXGCX

SEQ ID NO: 4040 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACTXGCXX

SEQ ID NO: 4041 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEIXCAYAACTGXC

SEQ ID NO: 4042 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAACTGXXC

SEQ ID NO: 4043 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACTGXXXC

SEQ ID NO: 4044 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACTGXXCX

SEQ ID NO: 4045 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAACTGXCX

SEQ ID NO: 4046 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACTGXCXX

SEQ ID NO: 4047 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEIXCAYAACTGCX

SEQ ID NO: 4048 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEIXCAYAACTGCXX

SEQ ID NO: 4049 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEIXCAYAACTGCXXX

SEQ ID NO: 4050 - protein, 17 aa, Artificial Sequence
  Synthetically generated peptide
  VARIANT (1)...(17): Xaa = Any Amino Acid
  VARIANT (1)...(17): Xaa = Any Amino Acid
PGTCGEICXAYAACTGC

SEQ ID NO: 4051 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICXXAYAACTGC

SEQ ID NO: 4052 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXXXAYAACTGC

SEQ ID NO: 4053 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXXXAYAACTGC

SEQ ID NO: 4054 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXXAXYAACTGC

SEQ ID NO: 4055 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXXAYXAACTGC

SEQ ID NO: 4056 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXXAYAXACTGC

SEQ ID NO: 4057 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXXAYAAXCTGC

SEQ ID NO: 4058 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXXAYAACXTGC

SEQ ID NO: 4059 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXXAYAACTXGC

SEQ ID NO: 4060 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXXAYAACTGXC

SEQ ID NO: 4061 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXXAYAACTGCX

SEQ ID NO: 4062 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXXAXYAACTGC

SEQ ID NO: 4063 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAXXYAACTGC

SEQ ID NO: 4064 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAXYXAACTGC

SEQ ID NO: 4065 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAXYAXACTGC

SEQ ID NO: 4066 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAXYAAXCTGC

SEQ ID NO: 4067 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAXYAACXTGC

SEQ ID NO: 4068 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAXYAACTXGC

SEQ ID NO: 4069 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAXYAACTGXC

SEQ ID NO: 4070 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAXYAACTGCX

SEQ ID NO: 4071 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXXAYXAACTGC

SEQ ID NO: 4072 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYXXAACTGC

SEQ ID NO: 4073 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYXAXACTGC

SEQ ID NO: 4074 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYXAAXCTGC

SEQ ID NO: 4075 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYXAACXTGC

SEQ ID NO: 4076 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYXAACTXGC

SEQ ID NO: 4077 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYXAACTGXC

SEQ ID NO: 4078 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYXAACTGCX

SEQ ID NO: 4079 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXXAYAXACTGC

SEQ ID NO: 4080 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAXXACTGC

SEQ ID NO: 4081 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAXAXCTGC

SEQ ID NO: 4082 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAXACXTGC

SEQ ID NO: 4083 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAXACTXGC

SEQ ID NO: 4084 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAXACTGXC

SEQ ID NO: 4085 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAXACTGCX

SEQ ID NO: 4086 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXXAYAAXCTGC

SEQ ID NO: 4087 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAAXXCTGC

SEQ ID NO: 4088 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAAXCXTGC

SEQ ID NO: 4089 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAAXCTXGC

SEQ ID NO: 4090 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAAXCTGXC

SEQ ID NO: 4091 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAAXCTGCX

SEQ ID NO: 4092 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXXAYAACXTGC

SEQ ID NO: 4093 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAACXXTGC

SEQ ID NO: 4094 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAACXTXGC

SEQ ID NO: 4095 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAACXTGXC

SEQ ID NO: 4096 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAACXTGCX

SEQ ID NO: 4097 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXXAYAACTXGC

SEQ ID NO: 4098 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAACTXXGC

SEQ ID NO: 4099 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAACTXGXC

SEQ ID NO: 4100 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAACTXGCX

SEQ ID NO: 4101 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXXAYAACTGXC

SEQ ID NO: 4102 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAACTGXXC

SEQ ID NO: 4103 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAACTGXCX

SEQ ID NO: 4104 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXXAYAACTGCX

SEQ ID NO: 4105 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXXAYAACTGCXX

SEQ ID NO: 4106 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICXAXYAACTGC

SEQ ID NO: 4107 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAXXYAACTGC

SEQ ID NO: 4108 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXXXYAACTGC

SEQ ID NO: 4109 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXXYXAACTGC

SEQ ID NO: 4110 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXXYAXACTGC

SEQ ID NO: 4111 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXXYAAXCTGC

SEQ ID NO: 4112 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXXYAACXTGC

SEQ ID NO: 4113 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXXYAACTXGC

SEQ ID NO: 4114 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXXYAACTGXC

SEQ ID NO: 4115 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXXYAACTGCX

SEQ ID NO: 4116 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAXYXAACTGC

SEQ ID NO: 4117 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYXXAACTGC

SEQ ID NO: 4118 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYXAXACTGC

SEQ ID NO: 4119 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYXAAXCTGC

SEQ ID NO: 4120 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYXAACXTGC

SEQ ID NO: 4121 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYXAACTXGC

SEQ ID NO: 4122 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYXAACTGXC

SEQ ID NO: 4123 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYXAACTGCX

SEQ ID NO: 4124 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAXYAXACTGC

SEQ ID NO: 4125 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAXXACTGC

SEQ ID NO: 4126 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAXAXCTGC

SEQ ID NO: 4127 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAXACXTGC

SEQ ID NO: 4128 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAXACTXGC

SEQ ID NO: 4129 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAXACTGXC

SEQ ID NO: 4130 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAXACTGCX

SEQ ID NO: 4131 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAXYAAXCTGC

SEQ ID NO: 4132 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAAXXCTGC

SEQ ID NO: 4133 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAAXCXTGC

SEQ ID NO: 4134 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAAXCTXGC

SEQ ID NO: 4135 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAAXCTGXC

SEQ ID NO: 4136 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAAXCTGCX

SEQ ID NO: 4137 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAXYAACXTGC

SEQ ID NO: 4138 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAACXXTGC

SEQ ID NO: 4139 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAACXTXGC

SEQ ID NO: 4140 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAACXTGXC

SEQ ID NO: 4141 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAACXTGCX

SEQ ID NO: 4142 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAXYAACTXGC

SEQ ID NO: 4143 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAACTXXGC

SEQ ID NO: 4144 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAACTXGXC

SEQ ID NO: 4145 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAACTXGCX

SEQ ID NO: 4146 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAXYAACTGXC

SEQ ID NO: 4147 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAACTGXXC

SEQ ID NO: 4148 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAACTGXCX

SEQ ID NO: 4149 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAXYAACTGCX

SEQ ID NO: 4150 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAXYAACTGCXX

SEQ ID NO: 4151 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICXAYXAACTGC

SEQ ID NO: 4152 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYXXAACTGC

SEQ ID NO: 4153 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXXXAACTGC

SEQ ID NO: 4154 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXXAXACTGC

SEQ ID NO: 4155 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXXAAXCTGC

SEQ ID NO: 4156 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXXAACXTGC

SEQ ID NO: 4157 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXXAACTXGC

SEQ ID NO: 4158 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXXAACTGXC

SEQ ID NO: 4159 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXXAACTGCX

SEQ ID NO: 4160 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYXAXACTGC

SEQ ID NO: 4161 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAXXACTGC

SEQ ID NO: 4162 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAXAXCTGC

SEQ ID NO: 4163 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAXACXTGC

SEQ ID NO: 4164 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAXACTXGC

SEQ ID NO: 4165 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAXACTGXC

SEQ ID NO: 4166 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAXACTGCX

SEQ ID NO: 4167 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYXAAXCTGC

SEQ ID NO: 4168 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAAXXCTGC

SEQ ID NO: 4169 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAAXCXTGC

SEQ ID NO: 4170 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAAXCTXGC

SEQ ID NO: 4171 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAAXCTGXC

SEQ ID NO: 4172 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAAXCTGCX

SEQ ID NO: 4173 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYXAACXTGC

SEQ ID NO: 4174 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAACXXTGC

SEQ ID NO: 4175 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAACXTXGC

SEQ ID NO: 4176 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAACXTGXC

SEQ ID NO: 4177 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAACXTGCX

SEQ ID NO: 4178 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYXAACTXGC

SEQ ID NO: 4179 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAACTXXGC

SEQ ID NO: 4180 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAACTXGXC

SEQ ID NO: 4181 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAACTXGCX

SEQ ID NO: 4182 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYXAACTGXC

SEQ ID NO: 4183 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAACTGXXC

SEQ ID NO: 4184 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAACTGXCX

SEQ ID NO: 4185 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYXAACTGCX

SEQ ID NO: 4186 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYXAACTGCXX

SEQ ID NO: 4187 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICXAYAXACTGC

SEQ ID NO: 4188 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAXXACTGC

SEQ ID NO: 4189 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXXXACTGC

SEQ ID NO: 4190 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXXAXCTGC

SEQ ID NO: 4191 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXXACXTGC

SEQ ID NO: 4192 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXXACTXGC

SEQ ID NO: 4193 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXXACTGXC

SEQ ID NO: 4194 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXXACTGCX

SEQ ID NO: 4195 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAXAXCTGC

SEQ ID NO: 4196 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXAXXCTGC

SEQ ID NO: 4197 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXAXCXTGC

SEQ ID NO: 4198 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXAXCTXGC

SEQ ID NO: 4199 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXAXCTGXC

SEQ ID NO: 4200 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXAXCTGCX

SEQ ID NO: 4201 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAXACXTGC

SEQ ID NO: 4202 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXACXXTGC

SEQ ID NO: 4203 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXACXTXGC

SEQ ID NO: 4204 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXACXTGXC

SEQ ID NO: 4205 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXACXTGCX

SEQ ID NO: 4206 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAXACTXGC

SEQ ID NO: 4207 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXACTXXGC

SEQ ID NO: 4208 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXACTXGXC

SEQ ID NO: 4209 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXACTXGCX

SEQ ID NO: 4210 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAXACTGXC

SEQ ID NO: 4211 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXACTGXXC

SEQ ID NO: 4212 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXACTGXCX

SEQ ID NO: 4213 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAXACTGCX

SEQ ID NO: 4214 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAXACTGCXX

SEQ ID NO: 4215 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICXAYAAXCTGC

SEQ ID NO: 4216 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAAXXCTGC

SEQ ID NO: 4217 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXXXCTGC

SEQ ID NO: 4218 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXXCXTGC

SEQ ID NO: 4219 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXXCTXGC

SEQ ID NO: 4220 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXXCTGXC

SEQ ID NO: 4221 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXXCTGCX

SEQ ID NO: 4222 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAAXCXTGC

SEQ ID NO: 4223 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXCXXTGC

SEQ ID NO: 4224 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXCXTXGC

SEQ ID NO: 4225 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXCXTGXC

SEQ ID NO: 4226 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXCXTGCX

SEQ ID NO: 4227 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAAXCTXGC

SEQ ID NO: 4228 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXCTXXGC

SEQ ID NO: 4229 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXCTXGXC

SEQ ID NO: 4230 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXCTXGCX

SEQ ID NO: 4231 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAAXCTGXC

SEQ ID NO: 4232 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXCTGXXC

SEQ ID NO: 4233 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXCTGXCX

SEQ ID NO: 4234 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAAXCTGCX

SEQ ID NO: 4235 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAAXCTGCXX

SEQ ID NO: 4236 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICXAYAACXTGC

SEQ ID NO: 4237 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAACXXTGC

SEQ ID NO: 4238 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACXXXTGC

SEQ ID NO: 4239 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACXXTXGC

SEQ ID NO: 4240 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACXXTGXC

SEQ ID NO: 4241 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACXXTGCX

SEQ ID NO: 4242 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAACXTXGC

SEQ ID NO: 4243 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACXTXXGC

SEQ ID NO: 4244 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACXTXGXC

SEQ ID NO: 4245 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACXTXGCX

SEQ ID NO: 4246 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAACXTGXC

SEQ ID NO: 4247 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACXTGXXC

SEQ ID NO: 4248 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACXTGXCX

SEQ ID NO: 4249 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAACXTGCX

SEQ ID NO: 4250 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACXTGCXX

SEQ ID NO: 4251 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICXAYAACTXGC

SEQ ID NO: 4252 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAACTXXGC

SEQ ID NO: 4253 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACTXXXGC

SEQ ID NO: 4254 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACTXXGXC

SEQ ID NO: 4255 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACTXXGCX

SEQ ID NO: 4256 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAACTXGXC

SEQ ID NO: 4257 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACTXGXXC

SEQ ID NO: 4258 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACTXGXCX

SEQ ID NO: 4259 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAACTXGCX

SEQ ID NO: 4260 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACTXGCXX

SEQ ID NO: 4261 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICXAYAACTGXC

SEQ ID NO: 4262 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAACTGXXC

SEQ ID NO: 4263 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACTGXXXC

SEQ ID NO: 4264 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACTGXXCX

SEQ ID NO: 4265 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAACTGXCX

SEQ ID NO: 4266 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACTGXCXX

SEQ ID NO: 4267 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICXAYAACTGCX

SEQ ID NO: 4268 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICXAYAACTGCXX

SEQ ID NO: 4269 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICXAYAACTGCXXX

SEQ ID NO: 4270 - protein, 17 aa, Artificial Sequence
  Synthetically generated peptide
  VARIANT (1)...(17): Xaa = Any Amino Acid
  VARIANT (1)...(17): Xaa = Any Amino Acid
PGTCGEICAXYAACTGC

SEQ ID NO: 4271 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAXXYAACTGC

SEQ ID NO: 4272 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXXXYAACTGC

SEQ ID NO: 4273 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXXXYAACTGC

SEQ ID NO: 4274 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXXYXAACTGC

SEQ ID NO: 4275 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXXYAXACTGC

SEQ ID NO: 4276 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXXYAAXCTGC

SEQ ID NO: 4277 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXXYAACXTGC

SEQ ID NO: 4278 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXXYAACTXGC

SEQ ID NO: 4279 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXXYAACTGXC

SEQ ID NO: 4280 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXXYAACTGCX

SEQ ID NO: 4281 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXXYXAACTGC

SEQ ID NO: 4282 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYXXAACTGC

SEQ ID NO: 4283 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYXAXACTGC

SEQ ID NO: 4284 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYXAAXCTGC

SEQ ID NO: 4285 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYXAACXTGC

SEQ ID NO: 4286 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYXAACTXGC

SEQ ID NO: 4287 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYXAACTGXC

SEQ ID NO: 4288 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYXAACTGCX

SEQ ID NO: 4289 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXXYAXACTGC

SEQ ID NO: 4290 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAXXACTGC

SEQ ID NO: 4291 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAXAXCTGC

SEQ ID NO: 4292 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAXACXTGC

SEQ ID NO: 4293 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAXACTXGC

SEQ ID NO: 4294 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAXACTGXC

SEQ ID NO: 4295 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAXACTGCX

SEQ ID NO: 4296 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXXYAAXCTGC

SEQ ID NO: 4297 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAAXXCTGC

SEQ ID NO: 4298 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAAXCXTGC

SEQ ID NO: 4299 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAAXCTXGC

SEQ ID NO: 4300 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAAXCTGXC

SEQ ID NO: 4301 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAAXCTGCX

SEQ ID NO: 4302 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXXYAACXTGC

SEQ ID NO: 4303 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAACXXTGC

SEQ ID NO: 4304 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAACXTXGC

SEQ ID NO: 4305 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAACXTGXC

SEQ ID NO: 4306 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAACXTGCX

SEQ ID NO: 4307 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXXYAACTXGC

SEQ ID NO: 4308 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAACTXXGC

SEQ ID NO: 4309 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAACTXGXC

SEQ ID NO: 4310 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAACTXGCX

SEQ ID NO: 4311 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXXYAACTGXC

SEQ ID NO: 4312 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAACTGXXC

SEQ ID NO: 4313 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAACTGXCX

SEQ ID NO: 4314 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXXYAACTGCX

SEQ ID NO: 4315 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXXYAACTGCXX

SEQ ID NO: 4316 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAXYXAACTGC

SEQ ID NO: 4317 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYXXAACTGC

SEQ ID NO: 4318 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXXXAACTGC

SEQ ID NO: 4319 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXXAXACTGC

SEQ ID NO: 4320 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXXAAXCTGC

SEQ ID NO: 4321 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXXAACXTGC

SEQ ID NO: 4322 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXXAACTXGC

SEQ ID NO: 4323 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXXAACTGXC

SEQ ID NO: 4324 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXXAACTGCX

SEQ ID NO: 4325 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYXAXACTGC

SEQ ID NO: 4326 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAXXACTGC

SEQ ID NO: 4327 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAXAXCTGC

SEQ ID NO: 4328 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAXACXTGC

SEQ ID NO: 4329 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAXACTXGC

SEQ ID NO: 4330 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAXACTGXC

SEQ ID NO: 4331 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAXACTGCX

SEQ ID NO: 4332 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYXAAXCTGC

SEQ ID NO: 4333 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAAXXCTGC

SEQ ID NO: 4334 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAAXCXTGC

SEQ ID NO: 4335 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAAXCTXGC

SEQ ID NO: 4336 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAAXCTGXC

SEQ ID NO: 4337 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAAXCTGCX

SEQ ID NO: 4338 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYXAACXTGC

SEQ ID NO: 4339 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAACXXTGC

SEQ ID NO: 4340 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAACXTXGC

SEQ ID NO: 4341 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAACXTGXC

SEQ ID NO: 4342 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAACXTGCX

SEQ ID NO: 4343 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYXAACTXGC

SEQ ID NO: 4344 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAACTXXGC

SEQ ID NO: 4345 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAACTXGXC

SEQ ID NO: 4346 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAACTXGCX

SEQ ID NO: 4347 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYXAACTGXC

SEQ ID NO: 4348 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAACTGXXC

SEQ ID NO: 4349 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAACTGXCX

SEQ ID NO: 4350 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYXAACTGCX

SEQ ID NO: 4351 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYXAACTGCXX

SEQ ID NO: 4352 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAXYAXACTGC

SEQ ID NO: 4353 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAXXACTGC

SEQ ID NO: 4354 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXXXACTGC

SEQ ID NO: 4355 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXXAXCTGC

SEQ ID NO: 4356 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXXACXTGC

SEQ ID NO: 4357 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXXACTXGC

SEQ ID NO: 4358 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXXACTGXC

SEQ ID NO: 4359 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXXACTGCX

SEQ ID NO: 4360 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAXAXCTGC

SEQ ID NO: 4361 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXAXXCTGC

SEQ ID NO: 4362 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXAXCXTGC

SEQ ID NO: 4363 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXAXCTXGC

SEQ ID NO: 4364 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXAXCTGXC

SEQ ID NO: 4365 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXAXCTGCX

SEQ ID NO: 4366 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAXACXTGC

SEQ ID NO: 4367 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXACXXTGC

SEQ ID NO: 4368 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXACXTXGC

SEQ ID NO: 4369 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXACXTGXC

SEQ ID NO: 4370 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXACXTGCX

SEQ ID NO: 4371 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAXACTXGC

SEQ ID NO: 4372 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXACTXXGC

SEQ ID NO: 4373 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXACTXGXC

SEQ ID NO: 4374 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXACTXGCX

SEQ ID NO: 4375 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAXACTGXC

SEQ ID NO: 4376 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXACTGXXC

SEQ ID NO: 4377 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXACTGXCX

SEQ ID NO: 4378 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAXACTGCX

SEQ ID NO: 4379 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAXACTGCXX

SEQ ID NO: 4380 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAXYAAXCTGC

SEQ ID NO: 4381 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAAXXCTGC

SEQ ID NO: 4382 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXXXCTGC

SEQ ID NO: 4383 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXXCXTGC

SEQ ID NO: 4384 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXXCTXGC

SEQ ID NO: 4385 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXXCTGXC

SEQ ID NO: 4386 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXXCTGCX

SEQ ID NO: 4387 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAAXCXTGC

SEQ ID NO: 4388 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXCXXTGC

SEQ ID NO: 4389 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXCXTXGC

SEQ ID NO: 4390 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXCXTGXC

SEQ ID NO: 4391 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXCXTGCX

SEQ ID NO: 4392 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAAXCTXGC

SEQ ID NO: 4393 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXCTXXGC

SEQ ID NO: 4394 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXCTXGXC

SEQ ID NO: 4395 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXCTXGCX

SEQ ID NO: 4396 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAAXCTGXC

SEQ ID NO: 4397 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXCTGXXC

SEQ ID NO: 4398 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXCTGXCX

SEQ ID NO: 4399 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAAXCTGCX

SEQ ID NO: 4400 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAAXCTGCXX

SEQ ID NO: 4401 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAXYAACXTGC

SEQ ID NO: 4402 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAACXXTGC

SEQ ID NO: 4403 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACXXXTGC

SEQ ID NO: 4404 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACXXTXGC

SEQ ID NO: 4405 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACXXTGXC

SEQ ID NO: 4406 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACXXTGCX

SEQ ID NO: 4407 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAACXTXGC

SEQ ID NO: 4408 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACXTXXGC

SEQ ID NO: 4409 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACXTXGXC

SEQ ID NO: 4410 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACXTXGCX

SEQ ID NO: 4411 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAACXTGXC

SEQ ID NO: 4412 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACXTGXXC

SEQ ID NO: 4413 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACXTGXCX

SEQ ID NO: 4414 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAACXTGCX

SEQ ID NO: 4415 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACXTGCXX

SEQ ID NO: 4416 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAXYAACTXGC

SEQ ID NO: 4417 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAACTXXGC

SEQ ID NO: 4418 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACTXXXGC

SEQ ID NO: 4419 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACTXXGXC

SEQ ID NO: 4420 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACTXXGCX

SEQ ID NO: 4421 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAACTXGXC

SEQ ID NO: 4422 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACTXGXXC

SEQ ID NO: 4423 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACTXGXCX

SEQ ID NO: 4424 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAACTXGCX

SEQ ID NO: 4425 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACTXGCXX

SEQ ID NO: 4426 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAXYAACTGXC

SEQ ID NO: 4427 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAACTGXXC

SEQ ID NO: 4428 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACTGXXXC

SEQ ID NO: 4429 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACTGXXCX

SEQ ID NO: 4430 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAACTGXCX

SEQ ID NO: 4431 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACTGXCXX

SEQ ID NO: 4432 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAXYAACTGCX

SEQ ID NO: 4433 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAXYAACTGCXX

SEQ ID NO: 4434 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAXYAACTGCXXX

SEQ ID NO: 4435 - protein, 17 aa, Artificial Sequence
  Synthetically generated peptide
  VARIANT (1)...(17): Xaa = Any Amino Acid
  VARIANT (1)...(17): Xaa = Any Amino Acid
PGTCGEICAYXAACTGC

SEQ ID NO: 4436 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYXXAACTGC

SEQ ID NO: 4437 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXXXAACTGC

SEQ ID NO: 4438 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXXXAACTGC

SEQ ID NO: 4439 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXXAXACTGC

SEQ ID NO: 4440 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXXAAXCTGC

SEQ ID NO: 4441 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXXAACXTGC

SEQ ID NO: 4442 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXXAACTXGC

SEQ ID NO: 4443 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXXAACTGXC

SEQ ID NO: 4444 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXXAACTGCX

SEQ ID NO: 4445 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXXAXACTGC

SEQ ID NO: 4446 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAXXACTGC

SEQ ID NO: 4447 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAXAXCTGC

SEQ ID NO: 4448 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAXACXTGC

SEQ ID NO: 4449 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAXACTXGC

SEQ ID NO: 4450 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAXACTGXC

SEQ ID NO: 4451 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAXACTGCX

SEQ ID NO: 4452 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXXAAXCTGC

SEQ ID NO: 4453 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAAXXCTGC

SEQ ID NO: 4454 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAAXCXTGC

SEQ ID NO: 4455 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAAXCTXGC

SEQ ID NO: 4456 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAAXCTGXC

SEQ ID NO: 4457 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAAXCTGCX

SEQ ID NO: 4458 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXXAACXTGC

SEQ ID NO: 4459 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAACXXTGC

SEQ ID NO: 4460 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAACXTXGC

SEQ ID NO: 4461 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAACXTGXC

SEQ ID NO: 4462 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAACXTGCX

SEQ ID NO: 4463 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXXAACTXGC

SEQ ID NO: 4464 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAACTXXGC

SEQ ID NO: 4465 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAACTXGXC

SEQ ID NO: 4466 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAACTXGCX

SEQ ID NO: 4467 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXXAACTGXC

SEQ ID NO: 4468 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAACTGXXC

SEQ ID NO: 4469 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAACTGXCX

SEQ ID NO: 4470 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXXAACTGCX

SEQ ID NO: 4471 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXXAACTGCXX

SEQ ID NO: 4472 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYXAXACTGC

SEQ ID NO: 4473 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAXXACTGC

SEQ ID NO: 4474 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXXXACTGC

SEQ ID NO: 4475 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXXAXCTGC

SEQ ID NO: 4476 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXXACXTGC

SEQ ID NO: 4477 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXXACTXGC

SEQ ID NO: 4478 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXXACTGXC

SEQ ID NO: 4479 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXXACTGCX

SEQ ID NO: 4480 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAXAXCTGC

SEQ ID NO: 4481 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXAXXCTGC

SEQ ID NO: 4482 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXAXCXTGC

SEQ ID NO: 4483 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXAXCTXGC

SEQ ID NO: 4484 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXAXCTGXC

SEQ ID NO: 4485 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXAXCTGCX

SEQ ID NO: 4486 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAXACXTGC

SEQ ID NO: 4487 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXACXXTGC

SEQ ID NO: 4488 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXACXTXGC

SEQ ID NO: 4489 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXACXTGXC

SEQ ID NO: 4490 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXACXTGCX

SEQ ID NO: 4491 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAXACTXGC

SEQ ID NO: 4492 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXACTXXGC

SEQ ID NO: 4493 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXACTXGXC

SEQ ID NO: 4494 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXACTXGCX

SEQ ID NO: 4495 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAXACTGXC

SEQ ID NO: 4496 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXACTGXXC

SEQ ID NO: 4497 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXACTGXCX

SEQ ID NO: 4498 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAXACTGCX

SEQ ID NO: 4499 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAXACTGCXX

SEQ ID NO: 4500 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYXAAXCTGC

SEQ ID NO: 4501 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAAXXCTGC

SEQ ID NO: 4502 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXXXCTGC

SEQ ID NO: 4503 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXXCXTGC

SEQ ID NO: 4504 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXXCTXGC

SEQ ID NO: 4505 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXXCTGXC

SEQ ID NO: 4506 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXXCTGCX

SEQ ID NO: 4507 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAAXCXTGC

SEQ ID NO: 4508 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXCXXTGC

SEQ ID NO: 4509 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXCXTXGC

SEQ ID NO: 4510 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXCXTGXC

SEQ ID NO: 4511 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXCXTGCX

SEQ ID NO: 4512 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAAXCTXGC

SEQ ID NO: 4513 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXCTXXGC

SEQ ID NO: 4514 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXCTXGXC

SEQ ID NO: 4515 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXCTXGCX

SEQ ID NO: 4516 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAAXCTGXC

SEQ ID NO: 4517 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXCTGXXC

SEQ ID NO: 4518 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXCTGXCX

SEQ ID NO: 4519 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAAXCTGCX

SEQ ID NO: 4520 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAAXCTGCXX

SEQ ID NO: 4521 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYXAACXTGC

SEQ ID NO: 4522 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAACXXTGC

SEQ ID NO: 4523 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACXXXTGC

SEQ ID NO: 4524 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACXXTXGC

SEQ ID NO: 4525 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACXXTGXC

SEQ ID NO: 4526 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACXXTGCX

SEQ ID NO: 4527 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAACXTXGC

SEQ ID NO: 4528 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACXTXXGC

SEQ ID NO: 4529 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACXTXGXC

SEQ ID NO: 4530 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACXTXGCX

SEQ ID NO: 4531 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAACXTGXC

SEQ ID NO: 4532 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACXTGXXC

SEQ ID NO: 4533 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACXTGXCX

SEQ ID NO: 4534 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAACXTGCX

SEQ ID NO: 4535 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACXTGCXX

SEQ ID NO: 4536 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYXAACTXGC

SEQ ID NO: 4537 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAACTXXGC

SEQ ID NO: 4538 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACTXXXGC

SEQ ID NO: 4539 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACTXXGXC

SEQ ID NO: 4540 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACTXXGCX

SEQ ID NO: 4541 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAACTXGXC

SEQ ID NO: 4542 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACTXGXXC

SEQ ID NO: 4543 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACTXGXCX

SEQ ID NO: 4544 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAACTXGCX

SEQ ID NO: 4545 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACTXGCXX

SEQ ID NO: 4546 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYXAACTGXC

SEQ ID NO: 4547 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAACTGXXC

SEQ ID NO: 4548 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACTGXXXC

SEQ ID NO: 4549 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACTGXXCX

SEQ ID NO: 4550 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAACTGXCX

SEQ ID NO: 4551 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACTGXCXX

SEQ ID NO: 4552 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYXAACTGCX

SEQ ID NO: 4553 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYXAACTGCXX

SEQ ID NO: 4554 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYXAACTGCXXX

SEQ ID NO: 4555 - protein, 17 aa, Artificial Sequence
  Synthetically generated peptide
  VARIANT (1)...(17): Xaa = Any Amino Acid
  VARIANT (1)...(17): Xaa = Any Amino Acid
PGTCGEICAYAXACTGC

SEQ ID NO: 4556 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAXXACTGC

SEQ ID NO: 4557 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXXXACTGC

SEQ ID NO: 4558 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXXXACTGC

SEQ ID NO: 4559 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXXAXCTGC

SEQ ID NO: 4560 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXXACXTGC

SEQ ID NO: 4561 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXXACTXGC

SEQ ID NO: 4562 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXXACTGXC

SEQ ID NO: 4563 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXXACTGCX

SEQ ID NO: 4564 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXXAXCTGC

SEQ ID NO: 4565 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXAXXCTGC

SEQ ID NO: 4566 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXAXCXTGC

SEQ ID NO: 4567 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXAXCTXGC

SEQ ID NO: 4568 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXAXCTGXC

SEQ ID NO: 4569 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXAXCTGCX

SEQ ID NO: 4570 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXXACXTGC

SEQ ID NO: 4571 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXACXXTGC

SEQ ID NO: 4572 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXACXTXGC

SEQ ID NO: 4573 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXACXTGXC

SEQ ID NO: 4574 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXACXTGCX

SEQ ID NO: 4575 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXXACTXGC

SEQ ID NO: 4576 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXACTXXGC

SEQ ID NO: 4577 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXACTXGXC

SEQ ID NO: 4578 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXACTXGCX

SEQ ID NO: 4579 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXXACTGXC

SEQ ID NO: 4580 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXACTGXXC

SEQ ID NO: 4581 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXACTGXCX

SEQ ID NO: 4582 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXXACTGCX

SEQ ID NO: 4583 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXXACTGCXX

SEQ ID NO: 4584 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAXAXCTGC

SEQ ID NO: 4585 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXAXXCTGC

SEQ ID NO: 4586 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXXXCTGC

SEQ ID NO: 4587 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXXCXTGC

SEQ ID NO: 4588 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXXCTXGC

SEQ ID NO: 4589 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXXCTGXC

SEQ ID NO: 4590 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXXCTGCX

SEQ ID NO: 4591 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXAXCXTGC

SEQ ID NO: 4592 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXCXXTGC

SEQ ID NO: 4593 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXCXTXGC

SEQ ID NO: 4594 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXCXTGXC

SEQ ID NO: 4595 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXCXTGCX

SEQ ID NO: 4596 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXAXCTXGC

SEQ ID NO: 4597 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXCTXXGC

SEQ ID NO: 4598 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXCTXGXC

SEQ ID NO: 4599 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXCTXGCX

SEQ ID NO: 4600 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXAXCTGXC

SEQ ID NO: 4601 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXCTGXXC

SEQ ID NO: 4602 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXCTGXCX

SEQ ID NO: 4603 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXAXCTGCX

SEQ ID NO: 4604 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXAXCTGCXX

SEQ ID NO: 4605 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAXACXTGC

SEQ ID NO: 4606 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXACXXTGC

SEQ ID NO: 4607 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACXXXTGC

SEQ ID NO: 4608 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACXXTXGC

SEQ ID NO: 4609 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACXXTGXC

SEQ ID NO: 4610 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACXXTGCX

SEQ ID NO: 4611 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXACXTXGC

SEQ ID NO: 4612 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACXTXXGC

SEQ ID NO: 4613 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACXTXGXC

SEQ ID NO: 4614 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACXTXGCX

SEQ ID NO: 4615 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXACXTGXC

SEQ ID NO: 4616 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACXTGXXC

SEQ ID NO: 4617 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACXTGXCX

SEQ ID NO: 4618 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXACXTGCX

SEQ ID NO: 4619 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACXTGCXX

SEQ ID NO: 4620 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAXACTXGC

SEQ ID NO: 4621 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXACTXXGC

SEQ ID NO: 4622 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACTXXXGC

SEQ ID NO: 4623 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACTXXGXC

SEQ ID NO: 4624 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACTXXGCX

SEQ ID NO: 4625 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXACTXGXC

SEQ ID NO: 4626 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACTXGXXC

SEQ ID NO: 4627 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACTXGXCX

SEQ ID NO: 4628 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXACTXGCX

SEQ ID NO: 4629 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACTXGCXX

SEQ ID NO: 4630 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAXACTGXC

SEQ ID NO: 4631 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXACTGXXC

SEQ ID NO: 4632 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACTGXXXC

SEQ ID NO: 4633 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACTGXXCX

SEQ ID NO: 4634 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXACTGXCX

SEQ ID NO: 4635 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACTGXCXX

SEQ ID NO: 4636 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAXACTGCX

SEQ ID NO: 4637 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAXACTGCXX

SEQ ID NO: 4638 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAXACTGCXXX

SEQ ID NO: 4639 - protein, 17 aa, Artificial Sequence
  Synthetically generated peptide
  VARIANT (1)...(17): Xaa = Any Amino Acid
  VARIANT (1)...(17): Xaa = Any Amino Acid
PGTCGEICAYAAXCTGC

SEQ ID NO: 4640 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAAXXCTGC

SEQ ID NO: 4641 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXXXCTGC

SEQ ID NO: 4642 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXXXCTGC

SEQ ID NO: 4643 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXXCXTGC

SEQ ID NO: 4644 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXXCTXGC

SEQ ID NO: 4645 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXXCTGXC

SEQ ID NO: 4646 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXXCTGCX

SEQ ID NO: 4647 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXXCXTGC

SEQ ID NO: 4648 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXCXXTGC

SEQ ID NO: 4649 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXCXTXGC

SEQ ID NO: 4650 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXCXTGXC

SEQ ID NO: 4651 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXCXTGCX

SEQ ID NO: 4652 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXXCTXGC

SEQ ID NO: 4653 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXCTXXGC

SEQ ID NO: 4654 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXCTXGXC

SEQ ID NO: 4655 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXCTXGCX

SEQ ID NO: 4656 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXXCTGXC

SEQ ID NO: 4657 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXCTGXXC

SEQ ID NO: 4658 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXCTGXCX

SEQ ID NO: 4659 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXXCTGCX

SEQ ID NO: 4660 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXXCTGCXX

SEQ ID NO: 4661 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAAXCXTGC

SEQ ID NO: 4662 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXCXXTGC

SEQ ID NO: 4663 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCXXXTGC

SEQ ID NO: 4664 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCXXTXGC

SEQ ID NO: 4665 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCXXTGXC

SEQ ID NO: 4666 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCXXTGCX

SEQ ID NO: 4667 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXCXTXGC

SEQ ID NO: 4668 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCXTXXGC

SEQ ID NO: 4669 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCXTXGXC

SEQ ID NO: 4670 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCXTXGCX

SEQ ID NO: 4671 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXCXTGXC

SEQ ID NO: 4672 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCXTGXXC

SEQ ID NO: 4673 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCXTGXCX

SEQ ID NO: 4674 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXCXTGCX

SEQ ID NO: 4675 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCXTGCXX

SEQ ID NO: 4676 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAAXCTXGC

SEQ ID NO: 4677 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXCTXXGC

SEQ ID NO: 4678 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCTXXXGC

SEQ ID NO: 4679 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCTXXGXC

SEQ ID NO: 4680 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCTXXGCX

SEQ ID NO: 4681 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXCTXGXC

SEQ ID NO: 4682 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCTXGXXC

SEQ ID NO: 4683 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCTXGXCX

SEQ ID NO: 4684 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXCTXGCX

SEQ ID NO: 4685 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCTXGCXX

SEQ ID NO: 4686 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAAXCTGXC

SEQ ID NO: 4687 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXCTGXXC

SEQ ID NO: 4688 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCTGXXXC

SEQ ID NO: 4689 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCTGXXCX

SEQ ID NO: 4690 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXCTGXCX

SEQ ID NO: 4691 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCTGXCXX

SEQ ID NO: 4692 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAAXCTGCX

SEQ ID NO: 4693 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAAXCTGCXX

SEQ ID NO: 4694 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAAXCTGCXXX

SEQ ID NO: 4695 - protein, 17 aa, Artificial Sequence
  Synthetically generated peptide
  VARIANT (1)...(17): Xaa = Any Amino Acid
  VARIANT (1)...(17): Xaa = Any Amino Acid
PGTCGEICAYAACXTGC

SEQ ID NO: 4696 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAACXXTGC

SEQ ID NO: 4697 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACXXXTGC

SEQ ID NO: 4698 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXXXXTGC

SEQ ID NO: 4699 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXXXTXGC

SEQ ID NO: 4700 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXXXTGXC

SEQ ID NO: 4701 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXXXTGCX

SEQ ID NO: 4702 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACXXTXGC

SEQ ID NO: 4703 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXXTXXGC

SEQ ID NO: 4704 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXXTXGXC

SEQ ID NO: 4705 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXXTXGCX

SEQ ID NO: 4706 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACXXTGXC

SEQ ID NO: 4707 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXXTGXXC

SEQ ID NO: 4708 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXXTGXCX

SEQ ID NO: 4709 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACXXTGCX

SEQ ID NO: 4710 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXXTGCXX

SEQ ID NO: 4711 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAACXTXGC

SEQ ID NO: 4712 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACXTXXGC

SEQ ID NO: 4713 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXTXXXGC

SEQ ID NO: 4714 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXTXXGXC

SEQ ID NO: 4715 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXTXXGCX

SEQ ID NO: 4716 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACXTXGXC

SEQ ID NO: 4717 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXTXGXXC

SEQ ID NO: 4718 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXTXGXCX

SEQ ID NO: 4719 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACXTXGCX

SEQ ID NO: 4720 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXTXGCXX

SEQ ID NO: 4721 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAACXTGXC

SEQ ID NO: 4722 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACXTGXXC

SEQ ID NO: 4723 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXTGXXXC

SEQ ID NO: 4724 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXTGXXCX

SEQ ID NO: 4725 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACXTGXCX

SEQ ID NO: 4726 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXTGXCXX

SEQ ID NO: 4727 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAACXTGCX

SEQ ID NO: 4728 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACXTGCXX

SEQ ID NO: 4729 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACXTGCXXX

SEQ ID NO: 4730 - protein, 17 aa, Artificial Sequence
  Synthetically generated peptide
  VARIANT (1)...(17): Xaa = Any Amino Acid
  VARIANT (1)...(17): Xaa = Any Amino Acid
PGTCGEICAYAACTXGC

SEQ ID NO: 4731 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAACTXXGC

SEQ ID NO: 4732 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACTXXXGC

SEQ ID NO: 4733 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTXXXXGC

SEQ ID NO: 4734 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTXXXGXC

SEQ ID NO: 4735 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTXXXGCX

SEQ ID NO: 4736 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACTXXGXC

SEQ ID NO: 4737 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTXXGXXC

SEQ ID NO: 4738 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTXXGXCX

SEQ ID NO: 4739 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACTXXGCX

SEQ ID NO: 4740 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTXXGCXX

SEQ ID NO: 4741 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAACTXGXC

SEQ ID NO: 4742 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACTXGXXC

SEQ ID NO: 4743 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTXGXXXC

SEQ ID NO: 4744 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTXGXXCX

SEQ ID NO: 4745 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACTXGXCX

SEQ ID NO: 4746 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTXGXCXX

SEQ ID NO: 4747 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAACTXGCX

SEQ ID NO: 4748 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACTXGCXX

SEQ ID NO: 4749 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTXGCXXX

SEQ ID NO: 4750 - protein, 17 aa, Artificial Sequence
  Synthetically generated peptide
  VARIANT (1)...(17): Xaa = Any Amino Acid
  VARIANT (1)...(17): Xaa = Any Amino Acid
PGTCGEICAYAACTGXC

SEQ ID NO: 4751 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAACTGXXC

SEQ ID NO: 4752 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACTGXXXC

SEQ ID NO: 4753 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTGXXXXC

SEQ ID NO: 4754 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTGXXXCX

SEQ ID NO: 4755 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACTGXXCX

SEQ ID NO: 4756 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTGXXCXX

SEQ ID NO: 4757 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAACTGXCX

SEQ ID NO: 4758 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACTGXCXX

SEQ ID NO: 4759 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTGXCXXX

SEQ ID NO: 4760 - protein, 17 aa, Artificial Sequence
  Synthetically generated peptide
  VARIANT (1)...(17): Xaa = Any Amino Acid
  VARIANT (1)...(17): Xaa = Any Amino Acid
PGTCGEICAYAACTGCX

SEQ ID NO: 4761 - protein, 18 aa, Artificial Sequence
  Synthetically generated peptide
  VARIANT (1)...(18): Xaa = Any Amino Acid
  VARIANT (1)...(18): Xaa = Any Amino Acid
PGTCGEICAYAACTGCXX

SEQ ID NO: 4762 - protein, 19 aa, Artificial Sequence
  Synthetically generated peptide
  VARIANT (1)...(19): Xaa = Any Amino Acid
  VARIANT (1)...(19): Xaa = Any Amino Acid
PGTCGEICAYAACTGCXXX

SEQ ID NO: 4763 - protein, 20 aa, Artificial Sequence
  Synthetically generated peptide
  VARIANT (1)...(20): Xaa = Any Amino Acid
  VARIANT (1)...(20): Xaa = Any Amino Acid
PGTCGEICAYAACTGCXXXX

SEQ ID NO: 4764 - protein, 13 aa, Artificial Sequence
  Synthetically generated peptide
CEYCANPACTGCY

SEQ ID NO: 4765 - protein, 13 aa, Artificial Sequence
  Synthetically generated peptide
CEYCANPACTACY

SEQ ID NO: 4766 - protein, 13 aa, Artificial Sequence
  Synthetically generated peptide
CEYCANPACVGCY

SEQ ID NO: 4767 - protein, 13 aa, Artificial Sequence
  Synthetically generated peptide
CEYCANPACVACY

SEQ ID NO: 4768 - protein, 13 aa, Artificial Sequence
  Synthetically generated peptide
CEYCANPACGGCY

SEQ ID NO: 4769 - protein, 13 aa, Artificial Sequence
  Synthetically generated peptide
CEYCANPACGACY

SEQ ID NO: 4770 - protein, 13 aa, Artificial Sequence
  Synthetically generated peptide
CEYCANPTCTGCY

SEQ ID NO: 4771 - protein, 13 aa, Artificial Sequence
  Synthetically generated peptide
CEYCANPTCTACY

SEQ ID NO: 4772 - protein, 13 aa, Artificial Sequence
  Synthetically generated peptide
CEYCANPTCVGCY

SEQ ID NO: 4773 - protein, 13 aa, Artificial Sequence
  Synthetically generated peptide
CEYCANPTCVACY

SEQ ID NO: 4774 - protein, 13 aa, Artificial Sequence
  Synthetically generated peptide
CEYCANPTCGGCY

SEQ ID NO: 4775 - protein, 13 aa, Artificial Sequence
  Synthetically generated peptide
CEYCANPTCGACY

SEQ ID NO: 4776 - protein, 13 aa, Artificial Sequence
  Synthetically generated peptide
CEYCANGACTGCY

SEQ ID NO: 4777 - protein, 13 aa, Artificial Sequence
  Synthetically generated peptide
CEYCANGACTACY

SEQ ID NO: 4778 - protein, 13 aa, Artificial Sequence
  Synthetically generated peptide
CEYCANGACVGCY

SEQ ID NO: 4779 - protein, 13 aa, Artificial Sequence
  Synthetically generated peptide
CEYCANGACVACY

SEQ ID NO: 4780 - protein, 13 aa, Artificial Sequence
  Synthetically generated peptide
CEYCANGACGGCY

SEQ ID NO: 4781 - protein, 13 aa, Artificial Sequence
  Synthetically generated peptide
CEYCANGACGACY

SEQ ID NO: 4782 - protein, 13 aa, Artificial Sequence
  Synthetically generated peptide
CEYCANGTCTGCY

SEQ ID NO: 4783 - protein, 13 aa, Artificial Sequence
  Synthetically generated peptide
CEYCANGTCTACY

SEQ ID NO: 4784 - protein, 13 aa, Artificial Sequence
  Synthetically generated peptide
CEYCANGTCVGCY

SEQ ID NO: 4785 - protein, 13 aa, Artificial Sequence
  Synthetically generated peptide
CEYCANGTCVACY

SEQ ID NO: 4786 - protein, 13 aa, Artificial Sequence
  Synthetically generated peptide
CEYCANGTCGGCY

SEQ ID NO: 4787 - protein, 13 aa, Artificial Sequence
  Synthetically generated peptide
CEYCANGTCGACY

SEQ ID NO: 4788 - protein, 13 aa, Artificial Sequence
  Synthetically generated peptide
CEYCRNPACTGCY

SEQ ID NO: 4789 - protein, 13 aa, Artificial Sequence
  Synthetically generated peptide
CEYCRNPACTACY

SEQ ID NO: 4790 - protein, 13 aa, Artificial Sequence
  Synthetically generated peptide
CEYCRNPACVGCY

SEQ ID NO: 4791 - protein, 13 aa, Artificial Sequence
  Synthetically generated peptide
CEYCRNPACVACY

SEQ ID NO: 4792 - protein, 13 aa, Artificial Sequence
  Synthetically generated peptide
CEYCRNPACGGCY

SEQ ID NO: 4793 - protein, 13 aa, Artificial Sequence
  Synthetically generated peptide
CEYCRNPACGACY

SEQ ID NO: 4794 - protein, 13 aa, Artificial Sequence
  Synthetically generated peptide
CEYCRNPTCTGCY

SEQ ID NO: 4795 - protein, 13 aa, Artificial Sequence
  Synthetically generated peptide
CEYCRNPTCTACY

SEQ ID NO: 4796 - protein, 13 aa, Artificial Sequence
  Synthetically generated peptide
CEYCRNPTCVGCY

SEQ ID NO: 4797 - protein, 13 aa, Artificial Sequence
  Synthetically generated peptide
CEYCRNPTCVACY

SEQ ID NO: 4798 - protein, 13 aa, Artificial Sequence
  Synthetically generated peptide
CEYCRNPTCGGCY

SEQ ID NO: 4799 - protein, 13 aa, Artificial Sequence
  Synthetically generated peptide
CEYCRNPTCGACY

SEQ ID NO: 4800 - protein, 13 aa, Artificial Sequence
  Synthetically generated peptide
CEYCRNGACTGCY

SEQ ID NO: 4801 - protein, 13 aa, Artificial Sequence
  Synthetically generated peptide
CEYCRNGACTACY

SEQ ID NO: 4802 - protein, 13 aa, Artificial Sequence
  Synthetically generated peptide
CEYCRNGACVGCY

SEQ ID NO: 4803 - protein, 13 aa, Artificial Sequence
  Synthetically generated peptide
CEYCRNGACVACY

SEQ ID NO: 4804 - protein, 13 aa, Artificial Sequence
  Synthetically generated peptide
CEYCRNGACGGCY

SEQ ID NO: 4805 - protein, 13 aa, Artificial Sequence
  Synthetically generated peptide
CEYCRNGACGACY

SEQ ID NO: 4806 - protein, 13 aa, Artificial Sequence
  Synthetically generated peptide
CEYCRNGTCTGCY

SEQ ID NO: 4807 - protein, 13 aa, Artificial Sequence
  Synthetically generated peptide
CEYCRNGTCTACY

SEQ ID NO: 4808 - protein, 13 aa, Artificial Sequence
  Synthetically generated peptide
CEYCRNGTCVGCY

SEQ ID NO: 4809 - protein, 13 aa, Artificial Sequence
  Synthetically generated peptide
CEYCRNGTCVACY

SEQ ID NO: 4810 - protein, 13 aa, Artificial Sequence
  Synthetically generated peptide
CEYCRNGTCGGCY

SEQ ID NO: 4811 - protein, 13 aa, Artificial Sequence
  Synthetically generated peptide
CEYCRNGTCGACY

SEQ ID NO: 4812 - protein, 13 aa, Artificial Sequence
  Synthetically generated peptide
CEYCNNPACTGCY

SEQ ID NO: 4813 - protein, 13 aa, Artificial Sequence
  Synthetically generated peptide
CEYCNNPACTACY

SEQ ID NO: 4814 - protein, 13 aa, Artificial Sequence
  Synthetically generated peptide
CEYCNNPACVGCY

SEQ ID NO: 4815 - protein, 13 aa, Artificial Sequence
  Synthetically generated peptide
CEYCNNPACVACY

SEQ ID NO: 4816 - protein, 13 aa, Artificial Sequence
  Synthetically generated peptide
CEYCNNPACGGCY

SEQ ID NO: 4817 - protein, 13 aa, Artificial Sequence
  Synthetically generated peptide
CEYCNNPACGACY

SEQ ID NO: 4818 - protein, 13 aa, Artificial Sequence
  Synthetically generated peptide
CEYCNNPTCTGCY

SEQ ID NO: 4819 - protein, 13 aa, Artificial Sequence
  Synthetically generated peptide
CEYCNNPTCTACY

SEQ ID NO: 4820 - protein, 13 aa, Artificial Sequence
  Synthetically generated peptide
CEYCNNPTCVGCY

SEQ ID NO: 4821 - protein, 13 aa, Artificial Sequence
  Synthetically generated peptide
CEYCNNPTCVACY

SEQ ID NO: 4822 - protein, 13 aa, Artificial Sequence
  Synthetically generated peptide
CEYCNNPTCGGCY

SEQ ID NO: 4823 - protein, 13 aa, Artificial Sequence
  Synthetically generated peptide
CEYCNNPTCGACY

SEQ ID NO: 4824 - protein, 13 aa, Artificial Sequence
  Synthetically generated peptide
CEYCNNGACTGCY

SEQ ID NO: 4825 - protein, 13 aa, Artificial Sequence
  Synthetically generated peptide
CEYCNNGACTACY

SEQ ID NO: 4826 - protein, 13 aa, Artificial Sequence
  Synthetically generated peptide
CEYCNNGACVGCY

SEQ ID NO: 4827 - protein, 13 aa, Artificial Sequence
  Synthetically generated peptide
CEYCNNGACVACY

SEQ ID NO: 4828 - protein, 13 aa, Artificial Sequence
  Synthetically generated peptide
CEYCNNGACGGCY

SEQ ID NO: 4829 - protein, 13 aa, Artificial Sequence
  Synthetically generated peptide
CEYCNNGACGACY

SEQ ID NO: 4830 - protein, 13 aa, Artificial Sequence
  Synthetically generated peptide
CEYCNNGTCTGCY

SEQ ID NO: 4831 - protein, 13 aa, Artificial Sequence
  Synthetically generated peptide
CEYCNNGTCTACY

SEQ ID NO: 4832 - protein, 13 aa, Artificial Sequence
  Synthetically generated peptide
CEYCNNGTCVGCY

SEQ ID NO: 4833 - protein, 13 aa, Artificial Sequence
  Synthetically generated peptide
CEYCNNGTCVACY

SEQ ID NO: 4834 - protein, 13 aa, Artificial Sequence
  Synthetically generated peptide
CEYCNNGTCGGCY

SEQ ID NO: 4835 - protein, 13 aa, Artificial Sequence
  Synthetically generated peptide
CEYCNNGTCGACY

SEQ ID NO: 4836 - protein, 13 aa, Artificial Sequence
  Synthetically generated peptide
CEYCDNPACTGCY

SEQ ID NO: 4837 - protein, 13 aa, Artificial Sequence
  Synthetically generated peptide
CEYCDNPACTACY

SEQ ID NO: 4838 - protein, 13 aa, Artificial Sequence
  Synthetically generated peptide
CEYCDNPACVGCY

SEQ ID NO: 4839 - protein, 13 aa, Artificial Sequence
  Synthetically generated peptide
CEYCDNPACVACY

SEQ ID NO: 4840 - protein, 13 aa, Artificial Sequence
  Synthetically generated peptide
CEYCDNPACGGCY

SEQ ID NO: 4841 - protein, 13 aa, Artificial Sequence
  Synthetically generated peptide
CEYCDNPACGACY

SEQ ID NO: 4842 - protein, 13 aa, Artificial Sequence
  Synthetically generated peptide
CEYCDNPTCTGCY

SEQ ID NO: 4843 - protein, 13 aa, Artificial Sequence
  Synthetically generated peptide
CEYCDNPTCTACY

SEQ ID NO: 4844 - protein, 13 aa, Artificial Sequence
  Synthetically generated peptide
CEYCDNPTCVGCY

SEQ ID NO: 4845 - protein, 13 aa, Artificial Sequence
  Synthetically generated peptide
CEYCDNPTCVACY

SEQ ID NO: 4846 - protein, 13 aa, Artificial Sequence
  Synthetically generated peptide
CEYCDNPTCGGCY

SEQ ID NO: 4847 - protein, 13 aa, Artificial Sequence
  Synthetically generated peptide
CEYCDNPTCGACY

SEQ ID NO: 4848 - protein, 13 aa, Artificial Sequence
  Synthetically generated peptide
CEYCDNGACTGCY

SEQ ID NO: 4849 - protein, 13 aa, Artificial Sequence
  Synthetically generated peptide
CEYCDNGACTACY

SEQ ID NO: 4850 - protein, 13 aa, Artificial Sequence
  Synthetically generated peptide
CEYCDNGACVGCY

SEQ ID NO: 4851 - protein, 13 aa, Artificial Sequence
  Synthetically generated peptide
CEYCDNGACVACY

SEQ ID NO: 4852 - protein, 13 aa, Artificial Sequence
  Synthetically generated peptide
CEYCDNGACGGCY

SEQ ID NO: 4853 - protein, 13 aa, Artificial Sequence
  Synthetically generated peptide
CEYCDNGACGACY

SEQ ID NO: 4854 - protein, 13 aa, Artificial Sequence
  Synthetically generated peptide
CEYCDNGTCTGCY

SEQ ID NO: 4855 - protein, 13 aa, Artificial Sequence
  Synthetically generated peptide
CEYCDNGTCTACY

SEQ ID NO: 4856 - protein, 13 aa, Artificial Sequence
  Synthetically generated peptide
CEYCDNGTCVGCY

SEQ ID NO: 4857 - protein, 13 aa, Artificial Sequence
  Synthetically generated peptide
CEYCDNGTCVACY

SEQ ID NO: 4858 - protein, 13 aa, Artificial Sequence
  Synthetically generated peptide
CEYCDNGTCGGCY

SEQ ID NO: 4859 - protein, 13 aa, Artificial Sequence
  Synthetically generated peptide
CEYCDNGTCGACY

SEQ ID NO: 4860 - protein, 13 aa, Artificial Sequence
  Synthetically generated peptide
CEYCQNPACTGCY

SEQ ID NO: 4861 - protein, 13 aa, Artificial Sequence
  Synthetically generated peptide
CEYCQNPACTACY

SEQ ID NO: 4862 - protein, 13 aa, Artificial Sequence
  Synthetically generated peptide
CEYCQNPACVGCY

SEQ ID NO: 4863 - protein, 13 aa, Artificial Sequence
  Synthetically generated peptide
CEYCQNPACVACY

SEQ ID NO: 4864 - protein, 13 aa, Artificial Sequence
  Synthetically generated peptide
CEYCQNPACGGCY

SEQ ID NO: 4865 - protein, 13 aa, Artificial Sequence
  Synthetically generated peptide
CEYCQNPACGACY

SEQ ID NO: 4866 - protein, 13 aa, Artificial Sequence
  Synthetically generated peptide
CEYCQNPTCTGCY

SEQ ID NO: 4867 - protein, 13 aa, Artificial Sequence
  Synthetically generated peptide
CEYCQNPTCTACY

SEQ ID NO: 4868 - protein, 13 aa, Artificial Sequence
  Synthetically generated peptide
CEYCQNPTCVGCY

SEQ ID NO: 4869 - protein, 13 aa, Artificial Sequence
  Synthetically generated peptide
CEYCQNPTCVACY

SEQ ID NO: 4870 - protein, 13 aa, Artificial Sequence
  Synthetically generated peptide
CEYCQNPTCGGCY

SEQ ID NO: 4871 - protein, 13 aa, Artificial Sequence
  Synthetically generated peptide
CEYCQNPTCGACY

SEQ ID NO: 4872 - protein, 13 aa, Artificial Sequence
  Synthetically generated peptide
CEYCQNGACTGCY

SEQ ID NO: 4873 - protein, 13 aa, Artificial Sequence
  Synthetically generated peptide
CEYCQNGACTACY

SEQ ID NO: 4874 - protein, 13 aa, Artificial Sequence
  Synthetically generated peptide
CEYCQNGACVGCY

SEQ ID NO: 4875 - protein, 13 aa, Artificial Sequence
  Synthetically generated peptide
CEYCQNGACVACY

SEQ ID NO: 4876 - protein, 13 aa, Artificial Sequence
  Synthetically generated peptide
CEYCQNGACGGCY

SEQ ID NO: 4877 - protein, 13 aa, Artificial Sequence
  Synthetically generated peptide
CEYCQNGACGACY

SEQ ID NO: 4878 - protein, 13 aa, Artificial Sequence
  Synthetically generated peptide
CEYCQNGTCTGCY

SEQ ID NO: 4879 - protein, 13 aa, Artificial Sequence
  Synthetically generated peptide
CEYCQNGTCTACY

SEQ ID NO: 4880 - protein, 13 aa, Artificial Sequence
  Synthetically generated peptide
CEYCQNGTCVGCY

SEQ ID NO: 4881 - protein, 13 aa, Artificial Sequence
  Synthetically generated peptide
CEYCQNGTCVACY

SEQ ID NO: 4882 - protein, 13 aa, Artificial Sequence
  Synthetically generated peptide
CEYCQNGTCGGCY

SEQ ID NO: 4883 - protein, 13 aa, Artificial Sequence
  Synthetically generated peptide
CEYCQNGTCGACY

SEQ ID NO: 4884 - protein, 13 aa, Artificial Sequence
  Synthetically generated peptide
CEYCENPACTGCY

SEQ ID NO: 4885 - protein, 13 aa, Artificial Sequence
  Synthetically generated peptide
CEYCENPACTACY

SEQ ID NO: 4886 - protein, 13 aa, Artificial Sequence
  Synthetically generated peptide
CEYCENPACVGCY

SEQ ID NO: 4887 - protein, 13 aa, Artificial Sequence
  Synthetically generated peptide
CEYCENPACVACY

SEQ ID NO: 4888 - protein, 13 aa, Artificial Sequence
  Synthetically generated peptide
CEYCENPACGGCY

SEQ ID NO: 4889 - protein, 13 aa, Artificial Sequence
  Synthetically generated peptide
CEYCENPACGACY

SEQ ID NO: 4890 - protein, 13 aa, Artificial Sequence
  Synthetically generated peptide
CEYCENPTCTGCY

SEQ ID NO: 4891 - protein, 13 aa, Artificial Sequence
  Synthetically generated peptide
CEYCENPTCTACY

SEQ ID NO: 4892 - protein, 13 aa, Artificial Sequence
  Synthetically generated peptide
CEYCENPTCVGCY

SEQ ID NO: 4893 - protein, 13 aa, Artificial Sequence
  Synthetically generated peptide
CEYCENPTCVACY

SEQ ID NO: 4894 - protein, 13 aa, Artificial Sequence
  Synthetically generated peptide
CEYCENPTCGGCY

SEQ ID NO: 4895 - protein, 13 aa, Artificial Sequence
  Synthetically generated peptide
CEYCENPTCGACY

SEQ ID NO: 4896 - protein, 13 aa, Artificial Sequence
  Synthetically generated peptide
CEYCENGACTGCY

SEQ ID NO: 4897 - protein, 13 aa, Artificial Sequence
  Synthetically generated peptide
CEYCENGACTACY

SEQ ID NO: 4898 - protein, 13 aa, Artificial Sequence
  Synthetically generated peptide
CEYCENGACVGCY

SEQ ID NO: 4899 - protein, 13 aa, Artificial Sequence
  Synthetically generated peptide
CEYCENGACVACY

SEQ ID NO: 4900 - protein, 13 aa, Artificial Sequence
  Synthetically generated peptide
CEYCENGACGGCY

SEQ ID NO: 4901 - protein, 13 aa, Artificial Sequence
  Synthetically generated peptide
CEYCENGACGACY

SEQ ID NO: 4902 - protein, 13 aa, Artificial Sequence
  Synthetically generated peptide
CEYCENGTCTGCY

SEQ ID NO: 4903 - protein, 13 aa, Artificial Sequence
  Synthetically generated peptide
CEYCENGTCTACY

SEQ ID NO: 4904 - protein, 13 aa, Artificial Sequence
  Synthetically generated peptide
CEYCENGTCVGCY

SEQ ID NO: 4905 - protein, 13 aa, Artificial Sequence
  Synthetically generated peptide
CEYCENGTCVACY

SEQ ID NO: 4906 - protein, 13 aa, Artificial Sequence
  Synthetically generated peptide
CEYCENGTCGGCY

SEQ ID NO: 4907 - protein, 13 aa, Artificial Sequence
  Synthetically generated peptide
CEYCENGTCGACY

SEQ ID NO: 4908 - protein, 13 aa, Artificial Sequence
  Synthetically generated peptide
CEYCGNPACTGCY

SEQ ID NO: 4909 - protein, 13 aa, Artificial Sequence
  Synthetically generated peptide
CEYCGNPACTACY

SEQ ID NO: 4910 - protein, 13 aa, Artificial Sequence
  Synthetically generated peptide
CEYCGNPACVGCY

SEQ ID NO: 4911 - protein, 13 aa, Artificial Sequence
  Synthetically generated peptide
CEYCGNPACVACY

SEQ ID NO: 4912 - protein, 13 aa, Artificial Sequence
  Synthetically generated peptide
CEYCGNPACGGCY

SEQ ID NO: 4913 - protein, 13 aa, Artificial Sequence
  Synthetically generated peptide
CEYCGNPACGACY

SEQ ID NO: 4914 - protein, 13 aa, Artificial Sequence
  Synthetically generated peptide
CEYCGNPTCTGCY

SEQ ID NO: 4915 - protein, 13 aa, Artificial Sequence
  Synthetically generated peptide
CEYCGNPTCTACY

SEQ ID NO: 4916 - protein, 13 aa, Artificial Sequence
  Synthetically generated peptide
CEYCGNPTCVGCY

SEQ ID NO: 4917 - protein, 13 aa, Artificial Sequence
  Synthetically generated peptide
CEYCGNPTCVACY

SEQ ID NO: 4918 - protein, 13 aa, Artificial Sequence
  Synthetically generated peptide
CEYCGNPTCGGCY

SEQ ID NO: 4919 - protein, 13 aa, Artificial Sequence
  Synthetically generated peptide
CEYCGNPTCGACY

SEQ ID NO: 4920 - protein, 13 aa, Artificial Sequence
  Synthetically generated peptide
CEYCGNGACTGCY

SEQ ID NO: 4921 - protein, 13 aa, Artificial Sequence
  Synthetically generated peptide
CEYCGNGACTACY

SEQ ID NO: 4922 - protein, 13 aa, Artificial Sequence
  Synthetically generated peptide
CEYCGNGACVGCY

SEQ ID NO: 4923 - protein, 13 aa, Artificial Sequence
  Synthetically generated peptide
CEYCGNGACVACY

SEQ ID NO: 4924 - protein, 13 aa, Artificial Sequence
  Synthetically generated peptide
CEYCGNGACGGCY

SEQ ID NO: 4925 - protein, 13 aa, Artificial Sequence
  Synthetically generated peptide
CEYCGNGACGACY

SEQ ID NO: 4926 - protein, 13 aa, Artificial Sequence
  Synthetically generated peptide
CEYCGNGTCTGCY

SEQ ID NO: 4927 - protein, 13 aa, Artificial Sequence
  Synthetically generated peptide
CEYCGNGTCTACY

SEQ ID NO: 4928 - protein, 13 aa, Artificial Sequence
  Synthetically generated peptide
CEYCGNGTCVGCY

SEQ ID NO: 4929 - protein, 13 aa, Artificial Sequence
  Synthetically generated peptide
CEYCGNGTCVACY

SEQ ID NO: 4930 - protein, 13 aa, Artificial Sequence
  Synthetically generated peptide
CEYCGNGTCGGCY

SEQ ID NO: 4931 - protein, 13 aa, Artificial Sequence
  Synthetically generated peptide
CEYCGNGTCGACY

SEQ ID NO: 4932 - protein, 13 aa, Artificial Sequence
  Synthetically generated peptide
CEYCHNPACTGCY

SEQ ID NO: 4933 - protein, 13 aa, Artificial Sequence
  Synthetically generated peptide
CEYCHNPACTACY

SEQ ID NO: 4934 - protein, 13 aa, Artificial Sequence
  Synthetically generated peptide
CEYCHNPACVGCY

SEQ ID NO: 4935 - protein, 13 aa, Artificial Sequence
  Synthetically generated peptide
CEYCHNPACVACY

SEQ ID NO: 4936 - protein, 13 aa, Artificial Sequence
  Synthetically generated peptide
CEYCHNPACGGCY

SEQ ID NO: 4937 - protein, 13 aa, Artificial Sequence
  Synthetically generated peptide
CEYCHNPACGACY

SEQ ID NO: 4938 - protein, 13 aa, Artificial Sequence
  Synthetically generated peptide
CEYCHNPTCTGCY

SEQ ID NO: 4939 - protein, 13 aa, Artificial Sequence
  Synthetically generated peptide
CEYCHNPTCTACY

SEQ ID NO: 4940 - protein, 13 aa, Artificial Sequence
  Synthetically generated peptide
CEYCHNPTCVGCY

SEQ ID NO: 4941 - protein, 13 aa, Artificial Sequence
  Synthetically generated peptide
CEYCHNPTCVACY

SEQ ID NO: 4942 - protein, 13 aa, Artificial Sequence
  Synthetically generated peptide
CEYCHNPTCGGCY

SEQ ID NO: 4943 - protein, 13 aa, Artificial Sequence
  Synthetically generated peptide
CEYCHNPTCGACY

SEQ ID NO: 4944 - protein, 13 aa, Artificial Sequence
  Synthetically generated peptide
CEYCHNGACTGCY

SEQ ID NO: 4945 - protein, 13 aa, Artificial Sequence
  Synthetically generated peptide
CEYCHNGACTACY

SEQ ID NO: 4946 - protein, 13 aa, Artificial Sequence
  Synthetically generated peptide
CEYCHNGACVGCY

SEQ ID NO: 4947 - protein, 13 aa, Artificial Sequence
  Synthetically generated peptide
CEYCHNGACVACY

SEQ ID NO: 4948 - protein, 13 aa, Artificial Sequence
  Synthetically generated peptide
CEYCHNGACGGCY

SEQ ID NO: 4949 - protein, 13 aa, Artificial Sequence
  Synthetically generated peptide
CEYCHNGACGACY

SEQ ID NO: 4950 - protein, 13 aa, Artificial Sequence
  Synthetically generated peptide
CEYCHNGTCTGCY

SEQ ID NO: 4951 - protein, 13 aa, Artificial Sequence
  Synthetically generated peptide
CEYCHNGTCTACY

SEQ ID NO: 4952 - protein, 13 aa, Artificial Sequence
  Synthetically generated peptide
CEYCHNGTCVGCY

SEQ ID NO: 4953 - protein, 13 aa, Artificial Sequence
  Synthetically generated peptide
CEYCHNGTCVACY

SEQ ID NO: 4954 - protein, 13 aa, Artificial Sequence
  Synthetically generated peptide
CEYCHNGTCGGCY

SEQ ID NO: 4955 - protein, 13 aa, Artificial Sequence
  Synthetically generated peptide
CEYCHNGTCGACY

SEQ ID NO: 4956 - protein, 13 aa, Artificial Sequence
  Synthetically generated peptide
CEYCINPACTGCY

SEQ ID NO: 4957 - protein, 13 aa, Artificial Sequence
  Synthetically generated peptide
CEYCINPACTACY

SEQ ID NO: 4958 - protein, 13 aa, Artificial Sequence
  Synthetically generated peptide
CEYCINPACVGCY

SEQ ID NO: 4959 - protein, 13 aa, Artificial Sequence
  Synthetically generated peptide
CEYCINPACVACY

SEQ ID NO: 4960 - protein, 13 aa, Artificial Sequence
  Synthetically generated peptide
CEYCINPACGGCY

SEQ ID NO: 4961 - protein, 13 aa, Artificial Sequence
  Synthetically generated peptide
CEYCINPACGACY

SEQ ID NO: 4962 - protein, 13 aa, Artificial Sequence
  Synthetically generated peptide
CEYCINPTCTGCY

SEQ ID NO: 4963 - protein, 13 aa, Artificial Sequence
  Synthetically generated peptide
CEYCINPTCTACY

SEQ ID NO: 4964 - protein, 13 aa, Artificial Sequence
  Synthetically generated peptide
CEYCINPTCVGCY

SEQ ID NO: 4965 - protein, 13 aa, Artificial Sequence
  Synthetically generated peptide
CEYCINPTCVACY

SEQ ID NO: 4966 - protein, 13 aa, Artificial Sequence
  Synthetically generated peptide
CEYCINPTCGGCY

SEQ ID NO: 4967 - protein, 13 aa, Artificial Sequence
  Synthetically generated peptide
CEYCINPTCGACY

SEQ ID NO: 4968 - protein, 13 aa, Artificial Sequence
  Synthetically generated peptide
CEYCINGACTGCY

SEQ ID NO: 4969 - protein, 13 aa, Artificial Sequence
  Synthetically generated peptide
CEYCINGACTACY

SEQ ID NO: 4970 - protein, 13 aa, Artificial Sequence
  Synthetically generated peptide
CEYCINGACVGCY

SEQ ID NO: 4971 - protein, 13 aa, Artificial Sequence
  Synthetically generated peptide
CEYCINGACVACY

SEQ ID NO: 4972 - protein, 13 aa, Artificial Sequence
  Synthetically generated peptide
CEYCINGACGGCY

SEQ ID NO: 4973 - protein, 13 aa, Artificial Sequence
  Synthetically generated peptide
CEYCINGACGACY

SEQ ID NO: 4974 - protein, 13 aa, Artificial Sequence
  Synthetically generated peptide
CEYCINGTCTGCY

SEQ ID NO: 4975 - protein, 13 aa, Artificial Sequence
  Synthetically generated peptide
CEYCINGTCTACY

SEQ ID NO: 4976 - protein, 13 aa, Artificial Sequence
  Synthetically generated peptide
CEYCINGTCVGCY

SEQ ID NO: 4977 - protein, 13 aa, Artificial Sequence
  Synthetically generated peptide
CEYCINGTCVACY

SEQ ID NO: 4978 - protein, 13 aa, Artificial Sequence
  Synthetically generated peptide
CEYCINGTCGGCY

SEQ ID NO: 4979 - protein, 13 aa, Artificial Sequence
  Synthetically generated peptide
CEYCINGTCGACY

SEQ ID NO: 4980 - protein, 13 aa, Artificial Sequence
  Synthetically generated peptide
CEYCLNPACTGCY

SEQ ID NO: 4981 - protein, 13 aa, Artificial Sequence
  Synthetically generated peptide
CEYCLNPACTACY

SEQ ID NO: 4982 - protein, 13 aa, Artificial Sequence
  Synthetically generated peptide
CEYCLNPACVGCY

SEQ ID NO: 4983 - protein, 13 aa, Artificial Sequence
  Synthetically generated peptide
CEYCLNPACVACY

SEQ ID NO: 4984 - protein, 13 aa, Artificial Sequence
  Synthetically generated peptide
CEYCLNPACGGCY

SEQ ID NO: 4985 - protein, 13 aa, Artificial Sequence
  Synthetically generated peptide
CEYCLNPACGACY

SEQ ID NO: 4986 - protein, 13 aa, Artificial Sequence
  Synthetically generated peptide
CEYCLNPTCTGCY

SEQ ID NO: 4987 - protein, 13 aa, Artificial Sequence
  Synthetically generated peptide
CEYCLNPTCTACY

SEQ ID NO: 4988 - protein, 13 aa, Artificial Sequence
  Synthetically generated peptide
CEYCLNPTCVGCY

SEQ ID NO: 4989 - protein, 13 aa, Artificial Sequence
  Synthetically generated peptide
CEYCLNPTCVACY

SEQ ID NO: 4990 - protein, 13 aa, Artificial Sequence
  Synthetically generated peptide
CEYCLNPTCGGCY

SEQ ID NO: 4991 - protein, 13 aa, Artificial Sequence
  Synthetically generated peptide
CEYCLNPTCGACY

SEQ ID NO: 4992 - protein, 13 aa, Artificial Sequence
  Synthetically generated peptide
CEYCLNGACTGCY

SEQ ID NO: 4993 - protein, 13 aa, Artificial Sequence
  Synthetically generated peptide
CEYCLNGACTACY

SEQ ID NO: 4994 - protein, 13 aa, Artificial Sequence
  Synthetically generated peptide
CEYCLNGACVGCY

SEQ ID NO: 4995 - protein, 13 aa, Artificial Sequence
  Synthetically generated peptide
CEYCLNGACVACY

SEQ ID NO: 4996 - protein, 13 aa, Artificial Sequence
  Synthetically generated peptide
CEYCLNGACGGCY

SEQ ID NO: 4997 - protein, 13 aa, Artificial Sequence
  Synthetically generated peptide
CEYCLNGACGACY

SEQ ID NO: 4998 - protein, 13 aa, Artificial Sequence
  Synthetically generated peptide
CEYCLNGTCTGCY

SEQ ID NO: 4999 - protein, 13 aa, Artificial Sequence
  Synthetically generated peptide
CEYCLNGTCTACY

SEQ ID NO: 5000 - protein, 13 aa, Artificial Sequence
  Synthetically generated peptide
CEYCLNGTCVGCY

SEQ ID NO: 5001 - protein, 13 aa, Artificial Sequence
  Synthetically generated peptide
CEYCLNGTCVACY

SEQ ID NO: 5002 - protein, 13 aa, Artificial Sequence
  Synthetically generated peptide
CEYCLNGTCGGCY

SEQ ID NO: 5003 - protein, 13 aa, Artificial Sequence
  Synthetically generated peptide
CEYCLNGTCGACY

SEQ ID NO: 5004 - protein, 13 aa, Artificial Sequence
  Synthetically generated peptide
CEYCKNPACTGCY

SEQ ID NO: 5005 - protein, 13 aa, Artificial Sequence
  Synthetically generated peptide
CEYCKNPACTACY

SEQ ID NO: 5006 - protein, 13 aa, Artificial Sequence
  Synthetically generated peptide
CEYCKNPACVGCY

SEQ ID NO: 5007 - protein, 13 aa, Artificial Sequence
  Synthetically generated peptide
CEYCKNPACVACY

SEQ ID NO: 5008 - protein, 13 aa, Artificial Sequence
  Synthetically generated peptide
CEYCKNPACGGCY

SEQ ID NO: 5009 - protein, 13 aa, Artificial Sequence
  Synthetically generated peptide
CEYCKNPACGACY

SEQ ID NO: 5010 - protein, 13 aa, Artificial Sequence
  Synthetically generated peptide
CEYCKNPTCTGCY

SEQ ID NO: 5011 - protein, 13 aa, Artificial Sequence
  Synthetically generated peptide
CEYCKNPTCTACY

SEQ ID NO: 5012 - protein, 13 aa, Artificial Sequence
  Synthetically generated peptide
CEYCKNPTCVGCY

SEQ ID NO: 5013 - protein, 13 aa, Artificial Sequence
  Synthetically generated peptide
CEYCKNPTCVACY

SEQ ID NO: 5014 - protein, 13 aa, Artificial Sequence
  Synthetically generated peptide
CEYCKNPTCGGCY

SEQ ID NO: 5015 - protein, 13 aa, Artificial Sequence
  Synthetically generated peptide
CEYCKNPTCGACY

SEQ ID NO: 5016 - protein, 13 aa, Artificial Sequence
  Synthetically generated peptide
CEYCKNGACTGCY

SEQ ID NO: 5017 - protein, 13 aa, Artificial Sequence
  Synthetically generated peptide
CEYCKNGACTACY

SEQ ID NO: 5018 - protein, 13 aa, Artificial Sequence
  Synthetically generated peptide
CEYCKNGACVGCY

SEQ ID NO: 5019 - protein, 13 aa, Artificial Sequence
  Synthetically generated peptide
CEYCKNGACVACY

SEQ ID NO: 5020 - protein, 13 aa, Artificial Sequence
  Synthetically generated peptide
CEYCKNGACGGCY

SEQ ID NO: 5021 - protein, 13 aa, Artificial Sequence
  Synthetically generated peptide
CEYCKNGACGACY

SEQ ID NO: 5022 - protein, 13 aa, Artificial Sequence
  Synthetically generated peptide
CEYCKNGTCTGCY

SEQ ID NO: 5023 - protein, 13 aa, Artificial Sequence
  Synthetically generated peptide
CEYCKNGTCTACY

SEQ ID NO: 5024 - protein, 13 aa, Artificial Sequence
  Synthetically generated peptide
CEYCKNGTCVGCY

SEQ ID NO: 5025 - protein, 13 aa, Artificial Sequence
  Synthetically generated peptide
CEYCKNGTCVACY

SEQ ID NO: 5026 - protein, 13 aa, Artificial Sequence
  Synthetically generated peptide
CEYCKNGTCGGCY

SEQ ID NO: 5027 - protein, 13 aa, Artificial Sequence
  Synthetically generated peptide
CEYCKNGTCGACY

SEQ ID NO: 5028 - protein, 13 aa, Artificial Sequence
  Synthetically generated peptide
CEYCMNPACTGCY

SEQ ID NO: 5029 - protein, 13 aa, Artificial Sequence
  Synthetically generated peptide
CEYCMNPACTACY

SEQ ID NO: 5030 - protein, 13 aa, Artificial Sequence
  Synthetically generated peptide
CEYCMNPACVGCY

SEQ ID NO: 5031 - protein, 13 aa, Artificial Sequence
  Synthetically generated peptide
CEYCMNPACVACY

SEQ ID NO: 5032 - protein, 13 aa, Artificial Sequence
  Synthetically generated peptide
CEYCMNPACGGCY

SEQ ID NO: 5033 - protein, 13 aa, Artificial Sequence
  Synthetically generated peptide
CEYCMNPACGACY

SEQ ID NO: 5034 - protein, 13 aa, Artificial Sequence
  Synthetically generated peptide
CEYCMNPTCTGCY

SEQ ID NO: 5035 - protein, 13 aa, Artificial Sequence
  Synthetically generated peptide
CEYCMNPTCTACY

SEQ ID NO: 5036 - protein, 13 aa, Artificial Sequence
  Synthetically generated peptide
CEYCMNPTCVGCY

SEQ ID NO: 5037 - protein, 13 aa, Artificial Sequence
  Synthetically generated peptide
CEYCMNPTCVACY

SEQ ID NO: 5038 - protein, 13 aa, Artificial Sequence
  Synthetically generated peptide
CEYCMNPTCGGCY

SEQ ID NO: 5039 - protein, 13 aa, Artificial Sequence
  Synthetically generated peptide
CEYCMNPTCGACY

SEQ ID NO: 5040 - protein, 13 aa, Artificial Sequence
  Synthetically generated peptide
CEYCMNGACTGCY

SEQ ID NO: 5041 - protein, 13 aa, Artificial Sequence
  Synthetically generated peptide
CEYCMNGACTACY

SEQ ID NO: 5042 - protein, 13 aa, Artificial Sequence
  Synthetically generated peptide
CEYCMNGACVGCY

SEQ ID NO: 5043 - protein, 13 aa, Artificial Sequence
  Synthetically generated peptide
CEYCMNGACVACY

SEQ ID NO: 5044 - protein, 13 aa, Artificial Sequence
  Synthetically generated peptide
CEYCMNGACGGCY

SEQ ID NO: 5045 - protein, 13 aa, Artificial Sequence
  Synthetically generated peptide
CEYCMNGACGACY

SEQ ID NO: 5046 - protein, 13 aa, Artificial Sequence
  Synthetically generated peptide
CEYCMNGTCTGCY

SEQ ID NO: 5047 - protein, 13 aa, Artificial Sequence
  Synthetically generated peptide
CEYCMNGTCTACY

SEQ ID NO: 5048 - protein, 13 aa, Artificial Sequence
  Synthetically generated peptide
CEYCMNGTCVGCY

SEQ ID NO: 5049 - protein, 13 aa, Artificial Sequence
  Synthetically generated peptide
CEYCMNGTCVACY

SEQ ID NO: 5050 - protein, 13 aa, Artificial Sequence
  Synthetically generated peptide
CEYCMNGTCGGCY

SEQ ID NO: 5051 - protein, 13 aa, Artificial Sequence
  Synthetically generated peptide
CEYCMNGTCGACY

SEQ ID NO: 5052 - protein, 13 aa, Artificial Sequence
  Synthetically generated peptide
CEYCFNPACTGCY

SEQ ID NO: 5053 - protein, 13 aa, Artificial Sequence
  Synthetically generated peptide
CEYCFNPACTACY

SEQ ID NO: 5054 - protein, 13 aa, Artificial Sequence
  Synthetically generated peptide
CEYCFNPACVGCY

SEQ ID NO: 5055 - protein, 13 aa, Artificial Sequence
  Synthetically generated peptide
CEYCFNPACVACY

SEQ ID NO: 5056 - protein, 13 aa, Artificial Sequence
  Synthetically generated peptide
CEYCFNPACGGCY

SEQ ID NO: 5057 - protein, 13 aa, Artificial Sequence
  Synthetically generated peptide
CEYCFNPACGACY

SEQ ID NO: 5058 - protein, 13 aa, Artificial Sequence
  Synthetically generated peptide
CEYCFNPTCTGCY

SEQ ID NO: 5059 - protein, 13 aa, Artificial Sequence
  Synthetically generated peptide
CEYCFNPTCTACY

SEQ ID NO: 5060 - protein, 13 aa, Artificial Sequence
  Synthetically generated peptide
CEYCFNPTCVGCY

SEQ ID NO: 5061 - protein, 13 aa, Artificial Sequence
  Synthetically generated peptide
CEYCFNPTCVACY

SEQ ID NO: 5062 - protein, 13 aa, Artificial Sequence
  Synthetically generated peptide
CEYCFNPTCGGCY

SEQ ID NO: 5063 - protein, 13 aa, Artificial Sequence
  Synthetically generated peptide
CEYCFNPTCGACY

SEQ ID NO: 5064 - protein, 13 aa, Artificial Sequence
  Synthetically generated peptide
CEYCFNGACTGCY

SEQ ID NO: 5065 - protein, 13 aa, Artificial Sequence
  Synthetically generated peptide
CEYCFNGACTACY

SEQ ID NO: 5066 - protein, 13 aa, Artificial Sequence
  Synthetically generated peptide
CEYCFNGACVGCY

SEQ ID NO: 5067 - protein, 13 aa, Artificial Sequence
  Synthetically generated peptide
CEYCFNGACVACY

SEQ ID NO: 5068 - protein, 13 aa, Artificial Sequence
  Synthetically generated peptide
CEYCFNGACGGCY

SEQ ID NO: 5069 - protein, 13 aa, Artificial Sequence
  Synthetically generated peptide
CEYCFNGACGACY

SEQ ID NO: 5070 - protein, 13 aa, Artificial Sequence
  Synthetically generated peptide
CEYCFNGTCTGCY

SEQ ID NO: 5071 - protein, 13 aa, Artificial Sequence
  Synthetically generated peptide
CEYCFNGTCTACY

SEQ ID NO: 5072 - protein, 13 aa, Artificial Sequence
  Synthetically generated peptide
CEYCFNGTCVGCY

SEQ ID NO: 5073 - protein, 13 aa, Artificial Sequence
  Synthetically generated peptide
CEYCFNGTCVACY

SEQ ID NO: 5074 - protein, 13 aa, Artificial Sequence
  Synthetically generated peptide
CEYCFNGTCGGCY

SEQ ID NO: 5075 - protein, 13 aa, Artificial Sequence
  Synthetically generated peptide
CEYCFNGTCGACY

SEQ ID NO: 5076 - protein, 13 aa, Artificial Sequence
  Synthetically generated peptide
CEYCPNPACTGCY

SEQ ID NO: 5077 - protein, 13 aa, Artificial Sequence
  Synthetically generated peptide
CEYCPNPACTACY

SEQ ID NO: 5078 - protein, 13 aa, Artificial Sequence
  Synthetically generated peptide
CEYCPNPACVGCY

SEQ ID NO: 5079 - protein, 13 aa, Artificial Sequence
  Synthetically generated peptide
CEYCPNPACVACY

SEQ ID NO: 5080 - protein, 13 aa, Artificial Sequence
  Synthetically generated peptide
CEYCPNPACGGCY

SEQ ID NO: 5081 - protein, 13 aa, Artificial Sequence
  Synthetically generated peptide
CEYCPNPACGACY

SEQ ID NO: 5082 - protein, 13 aa, Artificial Sequence
  Synthetically generated peptide
CEYCPNPTCTGCY

SEQ ID NO: 5083 - protein, 13 aa, Artificial Sequence
  Synthetically generated peptide
CEYCPNPTCTACY

SEQ ID NO: 5084 - protein, 13 aa, Artificial Sequence
  Synthetically generated peptide
CEYCPNPTCVGCY

SEQ ID NO: 5085 - protein, 13 aa, Artificial Sequence
  Synthetically generated peptide
CEYCPNPTCVACY

SEQ ID NO: 5086 - protein, 13 aa, Artificial Sequence
  Synthetically generated peptide
CEYCPNPTCGGCY

SEQ ID NO: 5087 - protein, 13 aa, Artificial Sequence
  Synthetically generated peptide
CEYCPNPTCGACY

SEQ ID NO: 5088 - protein, 13 aa, Artificial Sequence
  Synthetically generated peptide
CEYCPNGACTGCY

SEQ ID NO: 5089 - protein, 13 aa, Artificial Sequence
  Synthetically generated peptide
CEYCPNGACTACY

SEQ ID NO: 5090 - protein, 13 aa, Artificial Sequence
  Synthetically generated peptide
CEYCPNGACVGCY

SEQ ID NO: 5091 - protein, 13 aa, Artificial Sequence
  Synthetically generated peptide
CEYCPNGACVACY

SEQ ID NO: 5092 - protein, 13 aa, Artificial Sequence
  Synthetically generated peptide
CEYCPNGACGGCY

SEQ ID NO: 5093 - protein, 13 aa, Artificial Sequence
  Synthetically generated peptide
CEYCPNGACGACY

SEQ ID NO: 5094 - protein, 13 aa, Artificial Sequence
  Synthetically generated peptide
CEYCPNGTCTGCY

SEQ ID NO: 5095 - protein, 13 aa, Artificial Sequence
  Synthetically generated peptide
CEYCPNGTCTACY

SEQ ID NO: 5096 - protein, 13 aa, Artificial Sequence
  Synthetically generated peptide
CEYCPNGTCVGCY

SEQ ID NO: 5097 - protein, 13 aa, Artificial Sequence
  Synthetically generated peptide
CEYCPNGTCVACY

SEQ ID NO: 5098 - protein, 13 aa, Artificial Sequence
  Synthetically generated peptide
CEYCPNGTCGGCY

SEQ ID NO: 5099 - protein, 13 aa, Artificial Sequence
  Synthetically generated peptide
CEYCPNGTCGACY

SEQ ID NO: 5100 - protein, 13 aa, Artificial Sequence
  Synthetically generated peptide
CEYCSNPACTGCY

SEQ ID NO: 5101 - protein, 13 aa, Artificial Sequence
  Synthetically generated peptide
CEYCSNPACTACY

SEQ ID NO: 5102 - protein, 13 aa, Artificial Sequence
  Synthetically generated peptide
CEYCSNPACVGCY

SEQ ID NO: 5103 - protein, 13 aa, Artificial Sequence
  Synthetically generated peptide
CEYCSNPACVACY

SEQ ID NO: 5104 - protein, 13 aa, Artificial Sequence
  Synthetically generated peptide
CEYCSNPACGGCY

SEQ ID NO: 5105 - protein, 13 aa, Artificial Sequence
  Synthetically generated peptide
CEYCSNPACGACY

SEQ ID NO: 5106 - protein, 13 aa, Artificial Sequence
  Synthetically generated peptide
CEYCSNPTCTGCY

SEQ ID NO: 5107 - protein, 13 aa, Artificial Sequence
  Synthetically generated peptide
CEYCSNPTCTACY

SEQ ID NO: 5108 - protein, 13 aa, Artificial Sequence
  Synthetically generated peptide
CEYCSNPTCVGCY

SEQ ID NO: 5109 - protein, 13 aa, Artificial Sequence
  Synthetically generated peptide
CEYCSNPTCVACY

SEQ ID NO: 5110 - protein, 13 aa, Artificial Sequence
  Synthetically generated peptide
CEYCSNPTCGGCY

SEQ ID NO: 5111 - protein, 13 aa, Artificial Sequence
  Synthetically generated peptide
CEYCSNPTCGACY

SEQ ID NO: 5112 - protein, 13 aa, Artificial Sequence
  Synthetically generated peptide
CEYCSNGACTGCY

SEQ ID NO: 5113 - protein, 13 aa, Artificial Sequence
  Synthetically generated peptide
CEYCSNGACTACY

SEQ ID NO: 5114 - protein, 13 aa, Artificial Sequence
  Synthetically generated peptide
CEYCSNGACVGCY

SEQ ID NO: 5115 - protein, 13 aa, Artificial Sequence
  Synthetically generated peptide
CEYCSNGACVACY

SEQ ID NO: 5116 - protein, 13 aa, Artificial Sequence
  Synthetically generated peptide
CEYCSNGACGGCY

SEQ ID NO: 5117 - protein, 13 aa, Artificial Sequence
  Synthetically generated peptide
CEYCSNGACGACY

SEQ ID NO: 5118 - protein, 13 aa, Artificial Sequence
  Synthetically generated peptide
CEYCSNGTCTGCY

SEQ ID NO: 5119 - protein, 13 aa, Artificial Sequence
  Synthetically generated peptide
CEYCSNGTCTACY

SEQ ID NO: 5120 - protein, 13 aa, Artificial Sequence
  Synthetically generated peptide
CEYCSNGTCVGCY

SEQ ID NO: 5121 - protein, 13 aa, Artificial Sequence
  Synthetically generated peptide
CEYCSNGTCVACY

SEQ ID NO: 5122 - protein, 13 aa, Artificial Sequence
  Synthetically generated peptide
CEYCSNGTCGGCY

SEQ ID NO: 5123 - protein, 13 aa, Artificial Sequence
  Synthetically generated peptide
CEYCSNGTCGACY

SEQ ID NO: 5124 - protein, 13 aa, Artificial Sequence
  Synthetically generated peptide
CEYCTNPACTGCY

SEQ ID NO: 5125 - protein, 13 aa, Artificial Sequence
  Synthetically generated peptide
CEYCTNPACTACY

SEQ ID NO: 5126 - protein, 13 aa, Artificial Sequence
  Synthetically generated peptide
CEYCTNPACVGCY

SEQ ID NO: 5127 - protein, 13 aa, Artificial Sequence
  Synthetically generated peptide
CEYCTNPACVACY

SEQ ID NO: 5128 - protein, 13 aa, Artificial Sequence
  Synthetically generated peptide
CEYCTNPACGGCY

SEQ ID NO: 5129 - protein, 13 aa, Artificial Sequence
  Synthetically generated peptide
CEYCTNPACGACY

SEQ ID NO: 5130 - protein, 13 aa, Artificial Sequence
  Synthetically generated peptide
CEYCTNPTCTGCY

SEQ ID NO: 5131 - protein, 13 aa, Artificial Sequence
  Synthetically generated peptide
CEYCTNPTCTACY

SEQ ID NO: 5132 - protein, 13 aa, Artificial Sequence
  Synthetically generated peptide
CEYCTNPTCVGCY

SEQ ID NO: 5133 - protein, 13 aa, Artificial Sequence
  Synthetically generated peptide
CEYCTNPTCVACY

SEQ ID NO: 5134 - protein, 13 aa, Artificial Sequence
  Synthetically generated peptide
CEYCTNPTCGGCY

SEQ ID NO: 5135 - protein, 13 aa, Artificial Sequence
  Synthetically generated peptide
CEYCTNPTCGACY

SEQ ID NO: 5136 - protein, 13 aa, Artificial Sequence
  Synthetically generated peptide
CEYCTNGACTGCY

SEQ ID NO: 5137 - protein, 13 aa, Artificial Sequence
  Synthetically generated peptide
CEYCTNGACTACY

SEQ ID NO: 5138 - protein, 13 aa, Artificial Sequence
  Synthetically generated peptide
CEYCTNGACVGCY

SEQ ID NO: 5139 - protein, 13 aa, Artificial Sequence
  Synthetically generated peptide
CEYCTNGACVACY

SEQ ID NO: 5140 - protein, 13 aa, Artificial Sequence
  Synthetically generated peptide
CEYCTNGACGGCY

SEQ ID NO: 5141 - protein, 13 aa, Artificial Sequence
  Synthetically generated peptide
CEYCTNGACGACY

SEQ ID NO: 5142 - protein, 13 aa, Artificial Sequence
  Synthetically generated peptide
CEYCTNGTCTGCY

SEQ ID NO: 5143 - protein, 13 aa, Artificial Sequence
  Synthetically generated peptide
CEYCTNGTCTACY

SEQ ID NO: 5144 - protein, 13 aa, Artificial Sequence
  Synthetically generated peptide
CEYCTNGTCVGCY

SEQ ID NO: 5145 - protein, 13 aa, Artificial Sequence
  Synthetically generated peptide
CEYCTNGTCVACY

SEQ ID NO: 5146 - protein, 13 aa, Artificial Sequence
  Synthetically generated peptide
CEYCTNGTCGGCY

SEQ ID NO: 5147 - protein, 13 aa, Artificial Sequence
  Synthetically generated peptide
CEYCTNGTCGACY

SEQ ID NO: 5148 - protein, 13 aa, Artificial Sequence
  Synthetically generated peptide
CEYCWNPACTGCY

SEQ ID NO: 5149 - protein, 13 aa, Artificial Sequence
  Synthetically generated peptide
CEYCWNPACTACY

SEQ ID NO: 5150 - protein, 13 aa, Artificial Sequence
  Synthetically generated peptide
CEYCWNPACVGCY

SEQ ID NO: 5151 - protein, 13 aa, Artificial Sequence
  Synthetically generated peptide
CEYCWNPACVACY

SEQ ID NO: 5152 - protein, 13 aa, Artificial Sequence
  Synthetically generated peptide
CEYCWNPACGGCY

SEQ ID NO: 5153 - protein, 13 aa, Artificial Sequence
  Synthetically generated peptide
CEYCWNPACGACY

SEQ ID NO: 5154 - protein, 13 aa, Artificial Sequence
  Synthetically generated peptide
CEYCWNPTCTGCY

SEQ ID NO: 5155 - protein, 13 aa, Artificial Sequence
  Synthetically generated peptide
CEYCWNPTCTACY

SEQ ID NO: 5156 - protein, 13 aa, Artificial Sequence
  Synthetically generated peptide
CEYCWNPTCVGCY

SEQ ID NO: 5157 - protein, 13 aa, Artificial Sequence
  Synthetically generated peptide
CEYCWNPTCVACY

SEQ ID NO: 5158 - protein, 13 aa, Artificial Sequence
  Synthetically generated peptide
CEYCWNPTCGGCY

SEQ ID NO: 5159 - protein, 13 aa, Artificial Sequence
  Synthetically generated peptide
CEYCWNPTCGACY

SEQ ID NO: 5160 - protein, 13 aa, Artificial Sequence
  Synthetically generated peptide
CEYCWNGACTGCY

SEQ ID NO: 5161 - protein, 13 aa, Artificial Sequence
  Synthetically generated peptide
CEYCWNGACTACY

SEQ ID NO: 5162 - protein, 13 aa, Artificial Sequence
  Synthetically generated peptide
CEYCWNGACVGCY

SEQ ID NO: 5163 - protein, 13 aa, Artificial Sequence
  Synthetically generated peptide
CEYCWNGACVACY

SEQ ID NO: 5164 - protein, 13 aa, Artificial Sequence
  Synthetically generated peptide
CEYCWNGACGGCY

SEQ ID NO: 5165 - protein, 13 aa, Artificial Sequence
  Synthetically generated peptide
CEYCWNGACGACY

SEQ ID NO: 5166 - protein, 13 aa, Artificial Sequence
  Synthetically generated peptide
CEYCWNGTCTGCY

SEQ ID NO: 5167 - protein, 13 aa, Artificial Sequence
  Synthetically generated peptide
CEYCWNGTCTACY

SEQ ID NO: 5168 - protein, 13 aa, Artificial Sequence
  Synthetically generated peptide
CEYCWNGTCVGCY

SEQ ID NO: 5169 - protein, 13 aa, Artificial Sequence
  Synthetically generated peptide
CEYCWNGTCVACY

SEQ ID NO: 5170 - protein, 13 aa, Artificial Sequence
  Synthetically generated peptide
CEYCWNGTCGGCY

SEQ ID NO: 5171 - protein, 13 aa, Artificial Sequence
  Synthetically generated peptide
CEYCWNGTCGACY

SEQ ID NO: 5172 - protein, 13 aa, Artificial Sequence
  Synthetically generated peptide
CEYCYNPACTGCY

SEQ ID NO: 5173 - protein, 13 aa, Artificial Sequence
  Synthetically generated peptide
CEYCYNPACTACY

SEQ ID NO: 5174 - protein, 13 aa, Artificial Sequence
  Synthetically generated peptide
CEYCYNPACVGCY

SEQ ID NO: 5175 - protein, 13 aa, Artificial Sequence
  Synthetically generated peptide
CEYCYNPACVACY

SEQ ID NO: 5176 - protein, 13 aa, Artificial Sequence
  Synthetically generated peptide
CEYCYNPACGGCY

SEQ ID NO: 5177 - protein, 13 aa, Artificial Sequence
  Synthetically generated peptide
CEYCYNPACGACY

SEQ ID NO: 5178 - protein, 13 aa, Artificial Sequence
  Synthetically generated peptide
CEYCYNPTCTGCY

SEQ ID NO: 5179 - protein, 13 aa, Artificial Sequence
  Synthetically generated peptide
CEYCYNPTCTACY

SEQ ID NO: 5180 - protein, 13 aa, Artificial Sequence
  Synthetically generated peptide
CEYCYNPTCVGCY

SEQ ID NO: 5181 - protein, 13 aa, Artificial Sequence
  Synthetically generated peptide
CEYCYNPTCVACY

SEQ ID NO: 5182 - protein, 13 aa, Artificial Sequence
  Synthetically generated peptide
CEYCYNPTCGGCY

SEQ ID NO: 5183 - protein, 13 aa, Artificial Sequence
  Synthetically generated peptide
CEYCYNPTCGACY

SEQ ID NO: 5184 - protein, 13 aa, Artificial Sequence
  Synthetically generated peptide
CEYCYNGACTGCY

SEQ ID NO: 5185 - protein, 13 aa, Artificial Sequence
  Synthetically generated peptide
CEYCYNGACTACY

SEQ ID NO: 5186 - protein, 13 aa, Artificial Sequence
  Synthetically generated peptide
CEYCYNGACVGCY

SEQ ID NO: 5187 - protein, 13 aa, Artificial Sequence
  Synthetically generated peptide
CEYCYNGACVACY

SEQ ID NO: 5188 - protein, 13 aa, Artificial Sequence
  Synthetically generated peptide
CEYCYNGACGGCY

SEQ ID NO: 5189 - protein, 13 aa, Artificial Sequence
  Synthetically generated peptide
CEYCYNGACGACY

SEQ ID NO: 5190 - protein, 13 aa, Artificial Sequence
  Synthetically generated peptide
CEYCYNGTCTGCY

SEQ ID NO: 5191 - protein, 13 aa, Artificial Sequence
  Synthetically generated peptide
CEYCYNGTCTACY

SEQ ID NO: 5192 - protein, 13 aa, Artificial Sequence
  Synthetically generated peptide
CEYCYNGTCVGCY

SEQ ID NO: 5193 - protein, 13 aa, Artificial Sequence
  Synthetically generated peptide
CEYCYNGTCVACY

SEQ ID NO: 5194 - protein, 13 aa, Artificial Sequence
  Synthetically generated peptide
CEYCYNGTCGGCY

SEQ ID NO: 5195 - protein, 13 aa, Artificial Sequence
  Synthetically generated peptide
CEYCYNGTCGACY

SEQ ID NO: 5196 - protein, 13 aa, Artificial Sequence
  Synthetically generated peptide
CEYCVNPACTGCY

SEQ ID NO: 5197 - protein, 13 aa, Artificial Sequence
  Synthetically generated peptide
CEYCVNPACTACY

SEQ ID NO: 5198 - protein, 13 aa, Artificial Sequence
  Synthetically generated peptide
CEYCVNPACVGCY

SEQ ID NO: 5199 - protein, 13 aa, Artificial Sequence
  Synthetically generated peptide
CEYCVNPACVACY

SEQ ID NO: 5200 - protein, 13 aa, Artificial Sequence
  Synthetically generated peptide
CEYCVNPACGGCY

SEQ ID NO: 5201 - protein, 13 aa, Artificial Sequence
  Synthetically generated peptide
CEYCVNPACGACY

SEQ ID NO: 5202 - protein, 13 aa, Artificial Sequence
  Synthetically generated peptide
CEYCVNPTCTGCY

SEQ ID NO: 5203 - protein, 13 aa, Artificial Sequence
  Synthetically generated peptide
CEYCVNPTCTACY

SEQ ID NO: 5204 - protein, 13 aa, Artificial Sequence
  Synthetically generated peptide
CEYCVNPTCVGCY

SEQ ID NO: 5205 - protein, 13 aa, Artificial Sequence
  Synthetically generated peptide
CEYCVNPTCVACY

SEQ ID NO: 5206 - protein, 13 aa, Artificial Sequence
  Synthetically generated peptide
CEYCVNPTCGGCY

SEQ ID NO: 5207 - protein, 13 aa, Artificial Sequence
  Synthetically generated peptide
CEYCVNPTCGACY

SEQ ID NO: 5208 - protein, 13 aa, Artificial Sequence
  Synthetically generated peptide
CEYCVNGACTGCY

SEQ ID NO: 5209 - protein, 13 aa, Artificial Sequence
  Synthetically generated peptide
CEYCVNGACTACY

SEQ ID NO: 5210 - protein, 13 aa, Artificial Sequence
  Synthetically generated peptide
CEYCVNGACVGCY

SEQ ID NO: 5211 - protein, 13 aa, Artificial Sequence
  Synthetically generated peptide
CEYCVNGACVACY

SEQ ID NO: 5212 - protein, 13 aa, Artificial Sequence
  Synthetically generated peptide
CEYCVNGACGGCY

SEQ ID NO: 5213 - protein, 13 aa, Artificial Sequence
  Synthetically generated peptide
CEYCVNGACGACY

SEQ ID NO: 5214 - protein, 13 aa, Artificial Sequence
  Synthetically generated peptide
CEYCVNGTCTGCY

SEQ ID NO: 5215 - protein, 13 aa, Artificial Sequence
  Synthetically generated peptide
CEYCVNGTCTACY

SEQ ID NO: 5216 - protein, 13 aa, Artificial Sequence
  Synthetically generated peptide
CEYCVNGTCVGCY

SEQ ID NO: 5217 - protein, 13 aa, Artificial Sequence
  Synthetically generated peptide
CEYCVNGTCVACY

SEQ ID NO: 5218 - protein, 13 aa, Artificial Sequence
  Synthetically generated peptide
CEYCVNGTCGGCY

SEQ ID NO: 5219 - protein, 13 aa, Artificial Sequence
  Synthetically generated peptide
CEYCVNGTCGACY

SEQ ID NO: 5220 - protein, 12 aa, Artificial Sequence
  Synthetically generated peptide
CEYCNPACTGCY

SEQ ID NO: 5221 - protein, 12 aa, Artificial Sequence
  Synthetically generated peptide
CEYCNPACTACY

SEQ ID NO: 5222 - protein, 12 aa, Artificial Sequence
  Synthetically generated peptide
CEYCNPACVGCY

SEQ ID NO: 5223 - protein, 12 aa, Artificial Sequence
  Synthetically generated peptide
CEYCNPACVACY

SEQ ID NO: 5224 - protein, 12 aa, Artificial Sequence
  Synthetically generated peptide
CEYCNPACGGCY

SEQ ID NO: 5225 - protein, 12 aa, Artificial Sequence
  Synthetically generated peptide
CEYCNPACGACY

SEQ ID NO: 5226 - protein, 12 aa, Artificial Sequence
  Synthetically generated peptide
CEYCNPTCTGCY

SEQ ID NO: 5227 - protein, 12 aa, Artificial Sequence
  Synthetically generated peptide
CEYCNPTCTACY

SEQ ID NO: 5228 - protein, 12 aa, Artificial Sequence
  Synthetically generated peptide
CEYCNPTCVGCY

SEQ ID NO: 5229 - protein, 12 aa, Artificial Sequence
  Synthetically generated peptide
CEYCNPTCVACY

SEQ ID NO: 5230 - protein, 12 aa, Artificial Sequence
  Synthetically generated peptide
CEYCNPTCGGCY

SEQ ID NO: 5231 - protein, 12 aa, Artificial Sequence
  Synthetically generated peptide
CEYCNPTCGACY

SEQ ID NO: 5232 - protein, 12 aa, Artificial Sequence
  Synthetically generated peptide
CEYCNGACTGCY

SEQ ID NO: 5233 - protein, 12 aa, Artificial Sequence
  Synthetically generated peptide
CEYCNGACTACY

SEQ ID NO: 5234 - protein, 12 aa, Artificial Sequence
  Synthetically generated peptide
CEYCNGACVGCY

SEQ ID NO: 5235 - protein, 12 aa, Artificial Sequence
  Synthetically generated peptide
CEYCNGACVACY

SEQ ID NO: 5236 - protein, 12 aa, Artificial Sequence
  Synthetically generated peptide
CEYCNGACGGCY

SEQ ID NO: 5237 - protein, 12 aa, Artificial Sequence
  Synthetically generated peptide
CEYCNGACGACY

SEQ ID NO: 5238 - protein, 12 aa, Artificial Sequence
  Synthetically generated peptide
CEYCNGTCTGCY

SEQ ID NO: 5239 - protein, 12 aa, Artificial Sequence
  Synthetically generated peptide
CEYCNGTCTACY

SEQ ID NO: 5240 - protein, 12 aa, Artificial Sequence
  Synthetically generated peptide
CEYCNGTCVGCY

SEQ ID NO: 5241 - protein, 12 aa, Artificial Sequence
  Synthetically generated peptide
CEYCNGTCVACY

SEQ ID NO: 5242 - protein, 12 aa, Artificial Sequence
  Synthetically generated peptide
CEYCNGTCGGCY

SEQ ID NO: 5243 - protein, 12 aa, Artificial Sequence
  Synthetically generated peptide
CEYCNGTCGACY

SEQ ID NO: 5244 - protein, 13 aa, Artificial Sequence
  Synthetically generated peptide
CEWCANPACTGCY

SEQ ID NO: 5245 - protein, 13 aa, Artificial Sequence
  Synthetically generated peptide
CEWCANPACTACY

SEQ ID NO: 5246 - protein, 13 aa, Artificial Sequence
  Synthetically generated peptide
CEWCANPACVGCY

SEQ ID NO: 5247 - protein, 13 aa, Artificial Sequence
  Synthetically generated peptide
CEWCANPACVACY

SEQ ID NO: 5248 - protein, 13 aa, Artificial Sequence
  Synthetically generated peptide
CEWCANPACGGCY

SEQ ID NO: 5249 - protein, 13 aa, Artificial Sequence
  Synthetically generated peptide
CEWCANPACGACY

SEQ ID NO: 5250 - protein, 13 aa, Artificial Sequence
  Synthetically generated peptide
CEWCANPTCTGCY

SEQ ID NO: 5251 - protein, 13 aa, Artificial Sequence
  Synthetically generated peptide
CEWCANPTCTACY

SEQ ID NO: 5252 - protein, 13 aa, Artificial Sequence
  Synthetically generated peptide
CEWCANPTCVGCY

SEQ ID NO: 5253 - protein, 13 aa, Artificial Sequence
  Synthetically generated peptide
CEWCANPTCVACY

SEQ ID NO: 5254 - protein, 13 aa, Artificial Sequence
  Synthetically generated peptide
CEWCANPTCGGCY

SEQ ID NO: 5255 - protein, 13 aa, Artificial Sequence
  Synthetically generated peptide
CEWCANPTCGACY

SEQ ID NO: 5256 - protein, 13 aa, Artificial Sequence
  Synthetically generated peptide
CEWCANGACTGCY

SEQ ID NO: 5257 - protein, 13 aa, Artificial Sequence
  Synthetically generated peptide
CEWCANGACTACY

SEQ ID NO: 5258 - protein, 13 aa, Artificial Sequence
  Synthetically generated peptide
CEWCANGACVGCY

SEQ ID NO: 5259 - protein, 13 aa, Artificial Sequence
  Synthetically generated peptide
CEWCANGACVACY

SEQ ID NO: 5260 - protein, 13 aa, Artificial Sequence
  Synthetically generated peptide
CEWCANGACGGCY

SEQ ID NO: 5261 - protein, 13 aa, Artificial Sequence
  Synthetically generated peptide
CEWCANGACGACY

SEQ ID NO: 5262 - protein, 13 aa, Artificial Sequence
  Synthetically generated peptide
CEWCANGTCTGCY

SEQ ID NO: 5263 - protein, 13 aa, Artificial Sequence
  Synthetically generated peptide
CEWCANGTCTACY

SEQ ID NO: 5264 - protein, 13 aa, Artificial Sequence
  Synthetically generated peptide
CEWCANGTCVGCY

SEQ ID NO: 5265 - protein, 13 aa, Artificial Sequence
  Synthetically generated peptide
CEWCANGTCVACY

SEQ ID NO: 5266 - protein, 13 aa, Artificial Sequence
  Synthetically generated peptide
CEWCANGTCGGCY

SEQ ID NO: 5267 - protein, 13 aa, Artificial Sequence
  Synthetically generated peptide
CEWCANGTCGACY

SEQ ID NO: 5268 - protein, 13 aa, Artificial Sequence
  Synthetically generated peptide
CEWCRNPACTGCY

SEQ ID NO: 5269 - protein, 13 aa, Artificial Sequence
  Synthetically generated peptide
CEWCRNPACTACY

SEQ ID NO: 5270 - protein, 13 aa, Artificial Sequence
  Synthetically generated peptide
CEWCRNPACVGCY

SEQ ID NO: 5271 - protein, 13 aa, Artificial Sequence
  Synthetically generated peptide
CEWCRNPACVACY

SEQ ID NO: 5272 - protein, 13 aa, Artificial Sequence
  Synthetically generated peptide
CEWCRNPACGGCY

SEQ ID NO: 5273 - protein, 13 aa, Artificial Sequence
  Synthetically generated peptide
CEWCRNPACGACY

SEQ ID NO: 5274 - protein, 13 aa, Artificial Sequence
  Synthetically generated peptide
CEWCRNPTCTGCY

SEQ ID NO: 5275 - protein, 13 aa, Artificial Sequence
  Synthetically generated peptide
CEWCRNPTCTACY

SEQ ID NO: 5276 - protein, 13 aa, Artificial Sequence
  Synthetically generated peptide
CEWCRNPTCVGCY

SEQ ID NO: 5277 - protein, 13 aa, Artificial Sequence
  Synthetically generated peptide
CEWCRNPTCVACY

SEQ ID NO: 5278 - protein, 13 aa, Artificial Sequence
  Synthetically generated peptide
CEWCRNPTCGGCY

SEQ ID NO: 5279 - protein, 13 aa, Artificial Sequence
  Synthetically generated peptide
CEWCRNPTCGACY

SEQ ID NO: 5280 - protein, 13 aa, Artificial Sequence
  Synthetically generated peptide
CEWCRNGACTGCY

SEQ ID NO: 5281 - protein, 13 aa, Artificial Sequence
  Synthetically generated peptide
CEWCRNGACTACY

SEQ ID NO: 5282 - protein, 13 aa, Artificial Sequence
  Synthetically generated peptide
CEWCRNGACVGCY

SEQ ID NO: 5283 - protein, 13 aa, Artificial Sequence
  Synthetically generated peptide
CEWCRNGACVACY

SEQ ID NO: 5284 - protein, 13 aa, Artificial Sequence
  Synthetically generated peptide
CEWCRNGACGGCY

SEQ ID NO: 5285 - protein, 13 aa, Artificial Sequence
  Synthetically generated peptide
CEWCRNGACGACY

SEQ ID NO: 5286 - protein, 13 aa, Artificial Sequence
  Synthetically generated peptide
CEWCRNGTCTGCY

SEQ ID NO: 5287 - protein, 13 aa, Artificial Sequence
  Synthetically generated peptide
CEWCRNGTCTACY

SEQ ID NO: 5288 - protein, 13 aa, Artificial Sequence
  Synthetically generated peptide
CEWCRNGTCVGCY

SEQ ID NO: 5289 - protein, 13 aa, Artificial Sequence
  Synthetically generated peptide
CEWCRNGTCVACY

SEQ ID NO: 5290 - protein, 13 aa, Artificial Sequence
  Synthetically generated peptide
CEWCRNGTCGGCY

SEQ ID NO: 5291 - protein, 13 aa, Artificial Sequence
  Synthetically generated peptide
CEWCRNGTCGACY

SEQ ID NO: 5292 - protein, 13 aa, Artificial Sequence
  Synthetically generated peptide
CEWCNNPACTGCY

SEQ ID NO: 5293 - protein, 13 aa, Artificial Sequence
  Synthetically generated peptide
CEWCNNPACTACY

SEQ ID NO: 5294 - protein, 13 aa, Artificial Sequence
  Synthetically generated peptide
CEWCNNPACVGCY

SEQ ID NO: 5295 - protein, 13 aa, Artificial Sequence
  Synthetically generated peptide
CEWCNNPACVACY

SEQ ID NO: 5296 - protein, 13 aa, Artificial Sequence
  Synthetically generated peptide
CEWCNNPACGGCY

SEQ ID NO: 5297 - protein, 13 aa, Artificial Sequence
  Synthetically generated peptide
CEWCNNPACGACY

SEQ ID NO: 5298 - protein, 13 aa, Artificial Sequence
  Synthetically generated peptide
CEWCNNPTCTGCY

SEQ ID NO: 5299 - protein, 13 aa, Artificial Sequence
  Synthetically generated peptide
CEWCNNPTCTACY

SEQ ID NO: 5300 - protein, 13 aa, Artificial Sequence
  Synthetically generated peptide
CEWCNNPTCVGCY

SEQ ID NO: 5301 - protein, 13 aa, Artificial Sequence
  Synthetically generated peptide
CEWCNNPTCVACY

SEQ ID NO: 5302 - protein, 13 aa, Artificial Sequence
  Synthetically generated peptide
CEWCNNPTCGGCY

SEQ ID NO: 5303 - protein, 13 aa, Artificial Sequence
  Synthetically generated peptide
CEWCNNPTCGACY

SEQ ID NO: 5304 - protein, 13 aa, Artificial Sequence
  Synthetically generated peptide
CEWCNNGACTGCY

SEQ ID NO: 5305 - protein, 13 aa, Artificial Sequence
  Synthetically generated peptide
CEWCNNGACTACY

SEQ ID NO: 5306 - protein, 13 aa, Artificial Sequence
  Synthetically generated peptide
CEWCNNGACVGCY

SEQ ID NO: 5307 - protein, 13 aa, Artificial Sequence
  Synthetically generated peptide
CEWCNNGACVACY

SEQ ID NO: 5308 - protein, 13 aa, Artificial Sequence
  Synthetically generated peptide
CEWCNNGACGGCY

SEQ ID NO: 5309 - protein, 13 aa, Artificial Sequence
  Synthetically generated peptide
CEWCNNGACGACY

SEQ ID NO: 5310 - protein, 13 aa, Artificial Sequence
  Synthetically generated peptide
CEWCNNGTCTGCY

SEQ ID NO: 5311 - protein, 13 aa, Artificial Sequence
  Synthetically generated peptide
CEWCNNGTCTACY

SEQ ID NO: 5312 - protein, 13 aa, Artificial Sequence
  Synthetically generated peptide
CEWCNNGTCVGCY

SEQ ID NO: 5313 - protein, 13 aa, Artificial Sequence
  Synthetically generated peptide
CEWCNNGTCVACY

SEQ ID NO: 5314 - protein, 13 aa, Artificial Sequence
  Synthetically generated peptide
CEWCNNGTCGGCY

SEQ ID NO: 5315 - protein, 13 aa, Artificial Sequence
  Synthetically generated peptide
CEWCNNGTCGACY

SEQ ID NO: 5316 - protein, 13 aa, Artificial Sequence
  Synthetically generated peptide
CEWCDNPACTGCY

SEQ ID NO: 5317 - protein, 13 aa, Artificial Sequence
  Synthetically generated peptide
CEWCDNPACTACY

SEQ ID NO: 5318 - protein, 13 aa, Artificial Sequence
  Synthetically generated peptide
CEWCDNPACVGCY

SEQ ID NO: 5319 - protein, 13 aa, Artificial Sequence
  Synthetically generated peptide
CEWCDNPACVACY

SEQ ID NO: 5320 - protein, 13 aa, Artificial Sequence
  Synthetically generated peptide
CEWCDNPACGGCY

SEQ ID NO: 5321 - protein, 13 aa, Artificial Sequence
  Synthetically generated peptide
CEWCDNPACGACY

SEQ ID NO: 5322 - protein, 13 aa, Artificial Sequence
  Synthetically generated peptide
CEWCDNPTCTGCY

SEQ ID NO: 5323 - protein, 13 aa, Artificial Sequence
  Synthetically generated peptide
CEWCDNPTCTACY

SEQ ID NO: 5324 - protein, 13 aa, Artificial Sequence
  Synthetically generated peptide
CEWCDNPTCVGCY

SEQ ID NO: 5325 - protein, 13 aa, Artificial Sequence
  Synthetically generated peptide
CEWCDNPTCVACY

SEQ ID NO: 5326 - protein, 13 aa, Artificial Sequence
  Synthetically generated peptide
CEWCDNPTCGGCY

SEQ ID NO: 5327 - protein, 13 aa, Artificial Sequence
  Synthetically generated peptide
CEWCDNPTCGACY

SEQ ID NO: 5328 - protein, 13 aa, Artificial Sequence
  Synthetically generated peptide
CEWCDNGACTGCY

SEQ ID NO: 5329 - protein, 13 aa, Artificial Sequence
  Synthetically generated peptide
CEWCDNGACTACY

SEQ ID NO: 5330 - protein, 13 aa, Artificial Sequence
  Synthetically generated peptide
CEWCDNGACVGCY

SEQ ID NO: 5331 - protein, 13 aa, Artificial Sequence
  Synthetically generated peptide
CEWCDNGACVACY

SEQ ID NO: 5332 - protein, 13 aa, Artificial Sequence
  Synthetically generated peptide
CEWCDNGACGGCY

SEQ ID NO: 5333 - protein, 13 aa, Artificial Sequence
  Synthetically generated peptide
CEWCDNGACGACY

SEQ ID NO: 5334 - protein, 13 aa, Artificial Sequence
  Synthetically generated peptide
CEWCDNGTCTGCY

SEQ ID NO: 5335 - protein, 13 aa, Artificial Sequence
  Synthetically generated peptide
CEWCDNGTCTACY

SEQ ID NO: 5336 - protein, 13 aa, Artificial Sequence
  Synthetically generated peptide
CEWCDNGTCVGCY

SEQ ID NO: 5337 - protein, 13 aa, Artificial Sequence
  Synthetically generated peptide
CEWCDNGTCVACY

SEQ ID NO: 5338 - protein, 13 aa, Artificial Sequence
  Synthetically generated peptide
CEWCDNGTCGGCY

SEQ ID NO: 5339 - protein, 13 aa, Artificial Sequence
  Synthetically generated peptide
CEWCDNGTCGACY

SEQ ID NO: 5340 - protein, 13 aa, Artificial Sequence
  Synthetically generated peptide
CEWCQNPACTGCY

SEQ ID NO: 5341 - protein, 13 aa, Artificial Sequence
  Synthetically generated peptide
CEWCQNPACTACY

SEQ ID NO: 5342 - protein, 13 aa, Artificial Sequence
  Synthetically generated peptide
CEWCQNPACVGCY

SEQ ID NO: 5343 - protein, 13 aa, Artificial Sequence
  Synthetically generated peptide
CEWCQNPACVACY

SEQ ID NO: 5344 - protein, 13 aa, Artificial Sequence
  Synthetically generated peptide
CEWCQNPACGGCY

SEQ ID NO: 5345 - protein, 13 aa, Artificial Sequence
  Synthetically generated peptide
CEWCQNPACGACY

SEQ ID NO: 5346 - protein, 13 aa, Artificial Sequence
  Synthetically generated peptide
CEWCQNPTCTGCY

SEQ ID NO: 5347 - protein, 13 aa, Artificial Sequence
  Synthetically generated peptide
CEWCQNPTCTACY

SEQ ID NO: 5348 - protein, 13 aa, Artificial Sequence
  Synthetically generated peptide
CEWCQNPTCVGCY

SEQ ID NO: 5349 - protein, 13 aa, Artificial Sequence
  Synthetically generated peptide
CEWCQNPTCVACY

SEQ ID NO: 5350 - protein, 13 aa, Artificial Sequence
  Synthetically generated peptide
CEWCQNPTCGGCY

SEQ ID NO: 5351 - protein, 13 aa, Artificial Sequence
  Synthetically generated peptide
CEWCQNPTCGACY

SEQ ID NO: 5352 - protein, 13 aa, Artificial Sequence
  Synthetically generated peptide
CEWCQNGACTGCY

SEQ ID NO: 5353 - protein, 13 aa, Artificial Sequence
  Synthetically generated peptide
CEWCQNGACTACY

SEQ ID NO: 5354 - protein, 13 aa, Artificial Sequence
  Synthetically generated peptide
CEWCQNGACVGCY

SEQ ID NO: 5355 - protein, 13 aa, Artificial Sequence
  Synthetically generated peptide
CEWCQNGACVACY

SEQ ID NO: 5356 - protein, 13 aa, Artificial Sequence
  Synthetically generated peptide
CEWCQNGACGGCY

SEQ ID NO: 5357 - protein, 13 aa, Artificial Sequence
  Synthetically generated peptide
CEWCQNGACGACY

SEQ ID NO: 5358 - protein, 13 aa, Artificial Sequence
  Synthetically generated peptide
CEWCQNGTCTGCY

SEQ ID NO: 5359 - protein, 13 aa, Artificial Sequence
  Synthetically generated peptide
CEWCQNGTCTACY

SEQ ID NO: 5360 - protein, 13 aa, Artificial Sequence
  Synthetically generated peptide
CEWCQNGTCVGCY

SEQ ID NO: 5361 - protein, 13 aa, Artificial Sequence
  Synthetically generated peptide
CEWCQNGTCVACY

SEQ ID NO: 5362 - protein, 13 aa, Artificial Sequence
  Synthetically generated peptide
CEWCQNGTCGGCY

SEQ ID NO: 5363 - protein, 13 aa, Artificial Sequence
  Synthetically generated peptide
CEWCQNGTCGACY

SEQ ID NO: 5364 - protein, 13 aa, Artificial Sequence
  Synthetically generated peptide
CEWCENPACTGCY

SEQ ID NO: 5365 - protein, 13 aa, Artificial Sequence
  Synthetically generated peptide
CEWCENPACTACY

SEQ ID NO: 5366 - protein, 13 aa, Artificial Sequence
  Synthetically generated peptide
CEWCENPACVGCY

SEQ ID NO: 5367 - protein, 13 aa, Artificial Sequence
  Synthetically generated peptide
CEWCENPACVACY

SEQ ID NO: 5368 - protein, 13 aa, Artificial Sequence
  Synthetically generated peptide
CEWCENPACGGCY

SEQ ID NO: 5369 - protein, 13 aa, Artificial Sequence
  Synthetically generated peptide
CEWCENPACGACY

SEQ ID NO: 5370 - protein, 13 aa, Artificial Sequence
  Synthetically generated peptide
CEWCENPTCTGCY

SEQ ID NO: 5371 - protein, 13 aa, Artificial Sequence
  Synthetically generated peptide
CEWCENPTCTACY

SEQ ID NO: 5372 - protein, 13 aa, Artificial Sequence
  Synthetically generated peptide
CEWCENPTCVGCY

SEQ ID NO: 5373 - protein, 13 aa, Artificial Sequence
  Synthetically generated peptide
CEWCENPTCVACY

SEQ ID NO: 5374 - protein, 13 aa, Artificial Sequence
  Synthetically generated peptide
CEWCENPTCGGCY

SEQ ID NO: 5375 - protein, 13 aa, Artificial Sequence
  Synthetically generated peptide
CEWCENPTCGACY

SEQ ID NO: 5376 - protein, 13 aa, Artificial Sequence
  Synthetically generated peptide
CEWCENGACTGCY

SEQ ID NO: 5377 - protein, 13 aa, Artificial Sequence
  Synthetically generated peptide
CEWCENGACTACY

SEQ ID NO: 5378 - protein, 13 aa, Artificial Sequence
  Synthetically generated peptide
CEWCENGACVGCY

SEQ ID NO: 5379 - protein, 13 aa, Artificial Sequence
  Synthetically generated peptide
CEWCENGACVACY

SEQ ID NO: 5380 - protein, 13 aa, Artificial Sequence
  Synthetically generated peptide
CEWCENGACGGCY

SEQ ID NO: 5381 - protein, 13 aa, Artificial Sequence
  Synthetically generated peptide
CEWCENGACGACY

SEQ ID NO: 5382 - protein, 13 aa, Artificial Sequence
  Synthetically generated peptide
CEWCENGTCTGCY

SEQ ID NO: 5383 - protein, 13 aa, Artificial Sequence
  Synthetically generated peptide
CEWCENGTCTACY

SEQ ID NO: 5384 - protein, 13 aa, Artificial Sequence
  Synthetically generated peptide
CEWCENGTCVGCY

SEQ ID NO: 5385 - protein, 13 aa, Artificial Sequence
  Synthetically generated peptide
CEWCENGTCVACY

SEQ ID NO: 5386 - protein, 13 aa, Artificial Sequence
  Synthetically generated peptide
CEWCENGTCGGCY

SEQ ID NO: 5387 - protein, 13 aa, Artificial Sequence
  Synthetically generated peptide
CEWCENGTCGACY

SEQ ID NO: 5388 - protein, 13 aa, Artificial Sequence
  Synthetically generated peptide
CEWCGNPACTGCY

SEQ ID NO: 5389 - protein, 13 aa, Artificial Sequence
  Synthetically generated peptide
CEWCGNPACTACY

SEQ ID NO: 5390 - protein, 13 aa, Artificial Sequence
  Synthetically generated peptide
CEWCGNPACVGCY

SEQ ID NO: 5391 - protein, 13 aa, Artificial Sequence
  Synthetically generated peptide
CEWCGNPACVACY

SEQ ID NO: 5392 - protein, 13 aa, Artificial Sequence
  Synthetically generated peptide
CEWCGNPACGGCY

SEQ ID NO: 5393 - protein, 13 aa, Artificial Sequence
  Synthetically generated peptide
CEWCGNPACGACY

SEQ ID NO: 5394 - protein, 13 aa, Artificial Sequence
  Synthetically generated peptide
CEWCGNPTCTGCY

SEQ ID NO: 5395 - protein, 13 aa, Artificial Sequence
  Synthetically generated peptide
CEWCGNPTCTACY

SEQ ID NO: 5396 - protein, 13 aa, Artificial Sequence
  Synthetically generated peptide
CEWCGNPTCVGCY

SEQ ID NO: 5397 - protein, 13 aa, Artificial Sequence
  Synthetically generated peptide
CEWCGNPTCVACY

SEQ ID NO: 5398 - protein, 13 aa, Artificial Sequence
  Synthetically generated peptide
CEWCGNPTCGGCY

SEQ ID NO: 5399 - protein, 13 aa, Artificial Sequence
  Synthetically generated peptide
CEWCGNPTCGACY

SEQ ID NO: 5400 - protein, 13 aa, Artificial Sequence
  Synthetically generated peptide
CEWCGNGACTGCY

SEQ ID NO: 5401 - protein, 13 aa, Artificial Sequence
  Synthetically generated peptide
CEWCGNGACTACY

SEQ ID NO: 5402 - protein, 13 aa, Artificial Sequence
  Synthetically generated peptide
CEWCGNGACVGCY

SEQ ID NO: 5403 - protein, 13 aa, Artificial Sequence
  Synthetically generated peptide
CEWCGNGACVACY

SEQ ID NO: 5404 - protein, 13 aa, Artificial Sequence
  Synthetically generated peptide
CEWCGNGACGGCY

SEQ ID NO: 5405 - protein, 13 aa, Artificial Sequence
  Synthetically generated peptide
CEWCGNGACGACY

SEQ ID NO: 5406 - protein, 13 aa, Artificial Sequence
  Synthetically generated peptide
CEWCGNGTCTGCY

SEQ ID NO: 5407 - protein, 13 aa, Artificial Sequence
  Synthetically generated peptide
CEWCGNGTCTACY

SEQ ID NO: 5408 - protein, 13 aa, Artificial Sequence
  Synthetically generated peptide
CEWCGNGTCVGCY

SEQ ID NO: 5409 - protein, 13 aa, Artificial Sequence
  Synthetically generated peptide
CEWCGNGTCVACY

SEQ ID NO: 5410 - protein, 13 aa, Artificial Sequence
  Synthetically generated peptide
CEWCGNGTCGGCY

SEQ ID NO: 5411 - protein, 13 aa, Artificial Sequence
  Synthetically generated peptide
CEWCGNGTCGACY

SEQ ID NO: 5412 - protein, 13 aa, Artificial Sequence
  Synthetically generated peptide
CEWCHNPACTGCY

SEQ ID NO: 5413 - protein, 13 aa, Artificial Sequence
  Synthetically generated peptide
CEWCHNPACTACY

SEQ ID NO: 5414 - protein, 13 aa, Artificial Sequence
  Synthetically generated peptide
CEWCHNPACVGCY

SEQ ID NO: 5415 - protein, 13 aa, Artificial Sequence
  Synthetically generated peptide
CEWCHNPACVACY

SEQ ID NO: 5416 - protein, 13 aa, Artificial Sequence
  Synthetically generated peptide
CEWCHNPACGGCY

SEQ ID NO: 5417 - protein, 13 aa, Artificial Sequence
  Synthetically generated peptide
CEWCHNPACGACY

SEQ ID NO: 5418 - protein, 13 aa, Artificial Sequence
  Synthetically generated peptide
CEWCHNPTCTGCY

SEQ ID NO: 5419 - protein, 13 aa, Artificial Sequence
  Synthetically generated peptide
CEWCHNPTCTACY

SEQ ID NO: 5420 - protein, 13 aa, Artificial Sequence
  Synthetically generated peptide
CEWCHNPTCVGCY

SEQ ID NO: 5421 - protein, 13 aa, Artificial Sequence
  Synthetically generated peptide
CEWCHNPTCVACY

SEQ ID NO: 5422 - protein, 13 aa, Artificial Sequence
  Synthetically generated peptide
CEWCHNPTCGGCY

SEQ ID NO: 5423 - protein, 13 aa, Artificial Sequence
  Synthetically generated peptide
CEWCHNPTCGACY

SEQ ID NO: 5424 - protein, 13 aa, Artificial Sequence
  Synthetically generated peptide
CEWCHNGACTGCY

SEQ ID NO: 5425 - protein, 13 aa, Artificial Sequence
  Synthetically generated peptide
CEWCHNGACTACY

SEQ ID NO: 5426 - protein, 13 aa, Artificial Sequence
  Synthetically generated peptide
CEWCHNGACVGCY

SEQ ID NO: 5427 - protein, 13 aa, Artificial Sequence
  Synthetically generated peptide
CEWCHNGACVACY

SEQ ID NO: 5428 - protein, 13 aa, Artificial Sequence
  Synthetically generated peptide
CEWCHNGACGGCY

SEQ ID NO: 5429 - protein, 13 aa, Artificial Sequence
  Synthetically generated peptide
CEWCHNGACGACY

SEQ ID NO: 5430 - protein, 13 aa, Artificial Sequence
  Synthetically generated peptide
CEWCHNGTCTGCY

SEQ ID NO: 5431 - protein, 13 aa, Artificial Sequence
  Synthetically generated peptide
CEWCHNGTCTACY

SEQ ID NO: 5432 - protein, 13 aa, Artificial Sequence
  Synthetically generated peptide
CEWCHNGTCVGCY

SEQ ID NO: 5433 - protein, 13 aa, Artificial Sequence
  Synthetically generated peptide
CEWCHNGTCVACY

SEQ ID NO: 5434 - protein, 13 aa, Artificial Sequence
  Synthetically generated peptide
CEWCHNGTCGGCY

SEQ ID NO: 5435 - protein, 13 aa, Artificial Sequence
  Synthetically generated peptide
CEWCHNGTCGACY

SEQ ID NO: 5436 - protein, 13 aa, Artificial Sequence
  Synthetically generated peptide
CEWCINPACTGCY

SEQ ID NO: 5437 - protein, 13 aa, Artificial Sequence
  Synthetically generated peptide
CEWCINPACTACY

SEQ ID NO: 5438 - protein, 13 aa, Artificial Sequence
  Synthetically generated peptide
CEWCINPACVGCY

SEQ ID NO: 5439 - protein, 13 aa, Artificial Sequence
  Synthetically generated peptide
CEWCINPACVACY

SEQ ID NO: 5440 - protein, 13 aa, Artificial Sequence
  Synthetically generated peptide
CEWCINPACGGCY

SEQ ID NO: 5441 - protein, 13 aa, Artificial Sequence
  Synthetically generated peptide
CEWCINPACGACY

SEQ ID NO: 5442 - protein, 13 aa, Artificial Sequence
  Synthetically generated peptide
CEWCINPTCTGCY

SEQ ID NO: 5443 - protein, 13 aa, Artificial Sequence
  Synthetically generated peptide
CEWCINPTCTACY

SEQ ID NO: 5444 - protein, 13 aa, Artificial Sequence
  Synthetically generated peptide
CEWCINPTCVGCY

SEQ ID NO: 5445 - protein, 13 aa, Artificial Sequence
  Synthetically generated peptide
CEWCINPTCVACY

SEQ ID NO: 5446 - protein, 13 aa, Artificial Sequence
  Synthetically generated peptide
CEWCINPTCGGCY

SEQ ID NO: 5447 - protein, 13 aa, Artificial Sequence
  Synthetically generated peptide
CEWCINPTCGACY

SEQ ID NO: 5448 - protein, 13 aa, Artificial Sequence
  Synthetically generated peptide
CEWCINGACTGCY

SEQ ID NO: 5449 - protein, 13 aa, Artificial Sequence
  Synthetically generated peptide
CEWCINGACTACY

SEQ ID NO: 5450 - protein, 13 aa, Artificial Sequence
  Synthetically generated peptide
CEWCINGACVGCY

SEQ ID NO: 5451 - protein, 13 aa, Artificial Sequence
  Synthetically generated peptide
CEWCINGACVACY

SEQ ID NO: 5452 - protein, 13 aa, Artificial Sequence
  Synthetically generated peptide
CEWCINGACGGCY

SEQ ID NO: 5453 - protein, 13 aa, Artificial Sequence
  Synthetically generated peptide
CEWCINGACGACY

SEQ ID NO: 5454 - protein, 13 aa, Artificial Sequence
  Synthetically generated peptide
CEWCINGTCTGCY

SEQ ID NO: 5455 - protein, 13 aa, Artificial Sequence
  Synthetically generated peptide
CEWCINGTCTACY

SEQ ID NO: 5456 - protein, 13 aa, Artificial Sequence
  Synthetically generated peptide
CEWCINGTCVGCY

SEQ ID NO: 5457 - protein, 13 aa, Artificial Sequence
  Synthetically generated peptide
CEWCINGTCVACY

SEQ ID NO: 5458 - protein, 13 aa, Artificial Sequence
  Synthetically generated peptide
CEWCINGTCGGCY

SEQ ID NO: 5459 - protein, 13 aa, Artificial Sequence
  Synthetically generated peptide
CEWCINGTCGACY

SEQ ID NO: 5460 - protein, 13 aa, Artificial Sequence
  Synthetically generated peptide
CEWCLNPACTGCY

SEQ ID NO: 5461 - protein, 13 aa, Artificial Sequence
  Synthetically generated peptide
CEWCLNPACTACY

SEQ ID NO: 5462 - protein, 13 aa, Artificial Sequence
  Synthetically generated peptide
CEWCLNPACVGCY

SEQ ID NO: 5463 - protein, 13 aa, Artificial Sequence
  Synthetically generated peptide
CEWCLNPACVACY

SEQ ID NO: 5464 - protein, 13 aa, Artificial Sequence
  Synthetically generated peptide
CEWCLNPACGGCY

SEQ ID NO: 5465 - protein, 13 aa, Artificial Sequence
  Synthetically generated peptide
CEWCLNPACGACY

SEQ ID NO: 5466 - protein, 13 aa, Artificial Sequence
  Synthetically generated peptide
CEWCLNPTCTGCY

SEQ ID NO: 5467 - protein, 13 aa, Artificial Sequence
  Synthetically generated peptide
CEWCLNPTCTACY

SEQ ID NO: 5468 - protein, 13 aa, Artificial Sequence
  Synthetically generated peptide
CEWCLNPTCVGCY

SEQ ID NO: 5469 - protein, 13 aa, Artificial Sequence
  Synthetically generated peptide
CEWCLNPTCVACY

SEQ ID NO: 5470 - protein, 13 aa, Artificial Sequence
  Synthetically generated peptide
CEWCLNPTCGGCY

SEQ ID NO: 5471 - protein, 13 aa, Artificial Sequence
  Synthetically generated peptide
CEWCLNPTCGACY

SEQ ID NO: 5472 - protein, 13 aa, Artificial Sequence
  Synthetically generated peptide
CEWCLNGACTGCY

SEQ ID NO: 5473 - protein, 13 aa, Artificial Sequence
  Synthetically generated peptide
CEWCLNGACTACY

SEQ ID NO: 5474 - protein, 13 aa, Artificial Sequence
  Synthetically generated peptide
CEWCLNGACVGCY

SEQ ID NO: 5475 - protein, 13 aa, Artificial Sequence
  Synthetically generated peptide
CEWCLNGACVACY

SEQ ID NO: 5476 - protein, 13 aa, Artificial Sequence
  Synthetically generated peptide
CEWCLNGACGGCY

SEQ ID NO: 5477 - protein, 13 aa, Artificial Sequence
  Synthetically generated peptide
CEWCLNGACGACY

SEQ ID NO: 5478 - protein, 13 aa, Artificial Sequence
  Synthetically generated peptide
CEWCLNGTCTGCY

SEQ ID NO: 5479 - protein, 13 aa, Artificial Sequence
  Synthetically generated peptide
CEWCLNGTCTACY

SEQ ID NO: 5480 - protein, 13 aa, Artificial Sequence
  Synthetically generated peptide
CEWCLNGTCVGCY

SEQ ID NO: 5481 - protein, 13 aa, Artificial Sequence
  Synthetically generated peptide
CEWCLNGTCVACY

SEQ ID NO: 5482 - protein, 13 aa, Artificial Sequence
  Synthetically generated peptide
CEWCLNGTCGGCY

SEQ ID NO: 5483 - protein, 13 aa, Artificial Sequence
  Synthetically generated peptide
CEWCLNGTCGACY

SEQ ID NO: 5484 - protein, 13 aa, Artificial Sequence
  Synthetically generated peptide
CEWCKNPACTGCY

SEQ ID NO: 5485 - protein, 13 aa, Artificial Sequence
  Synthetically generated peptide
CEWCKNPACTACY

SEQ ID NO: 5486 - protein, 13 aa, Artificial Sequence
  Synthetically generated peptide
CEWCKNPACVGCY

SEQ ID NO: 5487 - protein, 13 aa, Artificial Sequence
  Synthetically generated peptide
CEWCKNPACVACY

SEQ ID NO: 5488 - protein, 13 aa, Artificial Sequence
  Synthetically generated peptide
CEWCKNPACGGCY

SEQ ID NO: 5489 - protein, 13 aa, Artificial Sequence
  Synthetically generated peptide
CEWCKNPACGACY

SEQ ID NO: 5490 - protein, 13 aa, Artificial Sequence
  Synthetically generated peptide
CEWCKNPTCTGCY

SEQ ID NO: 5491 - protein, 13 aa, Artificial Sequence
  Synthetically generated peptide
CEWCKNPTCTACY

SEQ ID NO: 5492 - protein, 13 aa, Artificial Sequence
  Synthetically generated peptide
CEWCKNPTCVGCY

SEQ ID NO: 5493 - protein, 13 aa, Artificial Sequence
  Synthetically generated peptide
CEWCKNPTCVACY

SEQ ID NO: 5494 - protein, 13 aa, Artificial Sequence
  Synthetically generated peptide
CEWCKNPTCGGCY

SEQ ID NO: 5495 - protein, 13 aa, Artificial Sequence
  Synthetically generated peptide
CEWCKNPTCGACY

SEQ ID NO: 5496 - protein, 13 aa, Artificial Sequence
  Synthetically generated peptide
CEWCKNGACTGCY

SEQ ID NO: 5497 - protein, 13 aa, Artificial Sequence
  Synthetically generated peptide
CEWCKNGACTACY

SEQ ID NO: 5498 - protein, 13 aa, Artificial Sequence
  Synthetically generated peptide
CEWCKNGACVGCY

SEQ ID NO: 5499 - protein, 13 aa, Artificial Sequence
  Synthetically generated peptide
CEWCKNGACVACY

SEQ ID NO: 5500 - protein, 13 aa, Artificial Sequence
  Synthetically generated peptide
CEWCKNGACGGCY

SEQ ID NO: 5501 - protein, 13 aa, Artificial Sequence
  Synthetically generated peptide
CEWCKNGACGACY

SEQ ID NO: 5502 - protein, 13 aa, Artificial Sequence
  Synthetically generated peptide
CEWCKNGTCTGCY

SEQ ID NO: 5503 - protein, 13 aa, Artificial Sequence
  Synthetically generated peptide
CEWCKNGTCTACY

SEQ ID NO: 5504 - protein, 13 aa, Artificial Sequence
  Synthetically generated peptide
CEWCKNGTCVGCY

SEQ ID NO: 5505 - protein, 13 aa, Artificial Sequence
  Synthetically generated peptide
CEWCKNGTCVACY

SEQ ID NO: 5506 - protein, 13 aa, Artificial Sequence
  Synthetically generated peptide
CEWCKNGTCGGCY

SEQ ID NO: 5507 - protein, 13 aa, Artificial Sequence
  Synthetically generated peptide
CEWCKNGTCGACY

SEQ ID NO: 5508 - protein, 13 aa, Artificial Sequence
  Synthetically generated peptide
CEWCMNPACTGCY

SEQ ID NO: 5509 - protein, 13 aa, Artificial Sequence
  Synthetically generated peptide
CEWCMNPACTACY

SEQ ID NO: 5510 - protein, 13 aa, Artificial Sequence
  Synthetically generated peptide
CEWCMNPACVGCY

SEQ ID NO: 5511 - protein, 13 aa, Artificial Sequence
  Synthetically generated peptide
CEWCMNPACVACY

SEQ ID NO: 5512 - protein, 13 aa, Artificial Sequence
  Synthetically generated peptide
CEWCMNPACGGCY

SEQ ID NO: 5513 - protein, 13 aa, Artificial Sequence
  Synthetically generated peptide
CEWCMNPACGACY

SEQ ID NO: 5514 - protein, 13 aa, Artificial Sequence
  Synthetically generated peptide
CEWCMNPTCTGCY

SEQ ID NO: 5515 - protein, 13 aa, Artificial Sequence
  Synthetically generated peptide
CEWCMNPTCTACY

SEQ ID NO: 5516 - protein, 13 aa, Artificial Sequence
  Synthetically generated peptide
CEWCMNPTCVGCY

SEQ ID NO: 5517 - protein, 13 aa, Artificial Sequence
  Synthetically generated peptide
CEWCMNPTCVACY

SEQ ID NO: 5518 - protein, 13 aa, Artificial Sequence
  Synthetically generated peptide
CEWCMNPTCGGCY

SEQ ID NO: 5519 - protein, 13 aa, Artificial Sequence
  Synthetically generated peptide
CEWCMNPTCGACY

SEQ ID NO: 5520 - protein, 13 aa, Artificial Sequence
  Synthetically generated peptide
CEWCMNGACTGCY

SEQ ID NO: 5521 - protein, 13 aa, Artificial Sequence
  Synthetically generated peptide
CEWCMNGACTACY

SEQ ID NO: 5522 - protein, 13 aa, Artificial Sequence
  Synthetically generated peptide
CEWCMNGACVGCY

SEQ ID NO: 5523 - protein, 13 aa, Artificial Sequence
  Synthetically generated peptide
CEWCMNGACVACY

SEQ ID NO: 5524 - protein, 13 aa, Artificial Sequence
  Synthetically generated peptide
CEWCMNGACGGCY

SEQ ID NO: 5525 - protein, 13 aa, Artificial Sequence
  Synthetically generated peptide
CEWCMNGACGACY

SEQ ID NO: 5526 - protein, 13 aa, Artificial Sequence
  Synthetically generated peptide
CEWCMNGTCTGCY

SEQ ID NO: 5527 - protein, 13 aa, Artificial Sequence
  Synthetically generated peptide
CEWCMNGTCTACY

SEQ ID NO: 5528 - protein, 13 aa, Artificial Sequence
  Synthetically generated peptide
CEWCMNGTCVGCY

SEQ ID NO: 5529 - protein, 13 aa, Artificial Sequence
  Synthetically generated peptide
CEWCMNGTCVACY

SEQ ID NO: 5530 - protein, 13 aa, Artificial Sequence
  Synthetically generated peptide
CEWCMNGTCGGCY

SEQ ID NO: 5531 - protein, 13 aa, Artificial Sequence
  Synthetically generated peptide
CEWCMNGTCGACY

SEQ ID NO: 5532 - protein, 13 aa, Artificial Sequence
  Synthetically generated peptide
CEWCFNPACTGCY

SEQ ID NO: 5533 - protein, 13 aa, Artificial Sequence
  Synthetically generated peptide
CEWCFNPACTACY

SEQ ID NO: 5534 - protein, 13 aa, Artificial Sequence
  Synthetically generated peptide
CEWCFNPACVGCY

SEQ ID NO: 5535 - protein, 13 aa, Artificial Sequence
  Synthetically generated peptide
CEWCFNPACVACY

SEQ ID NO: 5536 - protein, 13 aa, Artificial Sequence
  Synthetically generated peptide
CEWCFNPACGGCY

SEQ ID NO: 5537 - protein, 13 aa, Artificial Sequence
  Synthetically generated peptide
CEWCFNPACGACY

SEQ ID NO: 5538 - protein, 13 aa, Artificial Sequence
  Synthetically generated peptide
CEWCFNPTCTGCY

SEQ ID NO: 5539 - protein, 13 aa, Artificial Sequence
  Synthetically generated peptide
CEWCFNPTCTACY

SEQ ID NO: 5540 - protein, 13 aa, Artificial Sequence
  Synthetically generated peptide
CEWCFNPTCVGCY

SEQ ID NO: 5541 - protein, 13 aa, Artificial Sequence
  Synthetically generated peptide
CEWCFNPTCVACY

SEQ ID NO: 5542 - protein, 13 aa, Artificial Sequence
  Synthetically generated peptide
CEWCFNPTCGGCY

SEQ ID NO: 5543 - protein, 13 aa, Artificial Sequence
  Synthetically generated peptide
CEWCFNPTCGACY

SEQ ID NO: 5544 - protein, 13 aa, Artificial Sequence
  Synthetically generated peptide
CEWCFNGACTGCY

SEQ ID NO: 5545 - protein, 13 aa, Artificial Sequence
  Synthetically generated peptide
CEWCFNGACTACY

SEQ ID NO: 5546 - protein, 13 aa, Artificial Sequence
  Synthetically generated peptide
CEWCFNGACVGCY

SEQ ID NO: 5547 - protein, 13 aa, Artificial Sequence
  Synthetically generated peptide
CEWCFNGACVACY

SEQ ID NO: 5548 - protein, 13 aa, Artificial Sequence
  Synthetically generated peptide
CEWCFNGACGGCY

SEQ ID NO: 5549 - protein, 13 aa, Artificial Sequence
  Synthetically generated peptide
CEWCFNGACGACY

SEQ ID NO: 5550 - protein, 13 aa, Artificial Sequence
  Synthetically generated peptide
CEWCFNGTCTGCY

SEQ ID NO: 5551 - protein, 13 aa, Artificial Sequence
  Synthetically generated peptide
CEWCFNGTCTACY

SEQ ID NO: 5552 - protein, 13 aa, Artificial Sequence
  Synthetically generated peptide
CEWCFNGTCVGCY

SEQ ID NO: 5553 - protein, 13 aa, Artificial Sequence
  Synthetically generated peptide
CEWCFNGTCVACY

SEQ ID NO: 5554 - protein, 13 aa, Artificial Sequence
  Synthetically generated peptide
CEWCFNGTCGGCY

SEQ ID NO: 5555 - protein, 13 aa, Artificial Sequence
  Synthetically generated peptide
CEWCFNGTCGACY

SEQ ID NO: 5556 - protein, 13 aa, Artificial Sequence
  Synthetically generated peptide
CEWCPNPACTGCY

SEQ ID NO: 5557 - protein, 13 aa, Artificial Sequence
  Synthetically generated peptide
CEWCPNPACTACY

SEQ ID NO: 5558 - protein, 13 aa, Artificial Sequence
  Synthetically generated peptide
CEWCPNPACVGCY

SEQ ID NO: 5559 - protein, 13 aa, Artificial Sequence
  Synthetically generated peptide
CEWCPNPACVACY

SEQ ID NO: 5560 - protein, 13 aa, Artificial Sequence
  Synthetically generated peptide
CEWCPNPACGGCY

SEQ ID NO: 5561 - protein, 13 aa, Artificial Sequence
  Synthetically generated peptide
CEWCPNPACGACY

SEQ ID NO: 5562 - protein, 13 aa, Artificial Sequence
  Synthetically generated peptide
CEWCPNPTCTGCY

SEQ ID NO: 5563 - protein, 13 aa, Artificial Sequence
  Synthetically generated peptide
CEWCPNPTCTACY

SEQ ID NO: 5564 - protein, 13 aa, Artificial Sequence
  Synthetically generated peptide
CEWCPNPTCVGCY

SEQ ID NO: 5565 - protein, 13 aa, Artificial Sequence
  Synthetically generated peptide
CEWCPNPTCVACY

SEQ ID NO: 5566 - protein, 13 aa, Artificial Sequence
  Synthetically generated peptide
CEWCPNPTCGGCY

SEQ ID NO: 5567 - protein, 13 aa, Artificial Sequence
  Synthetically generated peptide
CEWCPNPTCGACY

SEQ ID NO: 5568 - protein, 13 aa, Artificial Sequence
  Synthetically generated peptide
CEWCPNGACTGCY

SEQ ID NO: 5569 - protein, 13 aa, Artificial Sequence
  Synthetically generated peptide
CEWCPNGACTACY

SEQ ID NO: 5570 - protein, 13 aa, Artificial Sequence
  Synthetically generated peptide
CEWCPNGACVGCY

SEQ ID NO: 5571 - protein, 13 aa, Artificial Sequence
  Synthetically generated peptide
CEWCPNGACVACY

SEQ ID NO: 5572 - protein, 13 aa, Artificial Sequence
  Synthetically generated peptide
CEWCPNGACGGCY

SEQ ID NO: 5573 - protein, 13 aa, Artificial Sequence
  Synthetically generated peptide
CEWCPNGACGACY

SEQ ID NO: 5574 - protein, 13 aa, Artificial Sequence
  Synthetically generated peptide
CEWCPNGTCTGCY

SEQ ID NO: 5575 - protein, 13 aa, Artificial Sequence
  Synthetically generated peptide
CEWCPNGTCTACY

SEQ ID NO: 5576 - protein, 13 aa, Artificial Sequence
  Synthetically generated peptide
CEWCPNGTCVGCY

SEQ ID NO: 5577 - protein, 13 aa, Artificial Sequence
  Synthetically generated peptide
CEWCPNGTCVACY

SEQ ID NO: 5578 - protein, 13 aa, Artificial Sequence
  Synthetically generated peptide
CEWCPNGTCGGCY

SEQ ID NO: 5579 - protein, 13 aa, Artificial Sequence
  Synthetically generated peptide
CEWCPNGTCGACY

SEQ ID NO: 5580 - protein, 13 aa, Artificial Sequence
  Synthetically generated peptide
CEWCSNPACTGCY

SEQ ID NO: 5581 - protein, 13 aa, Artificial Sequence
  Synthetically generated peptide
CEWCSNPACTACY

SEQ ID NO: 5582 - protein, 13 aa, Artificial Sequence
  Synthetically generated peptide
CEWCSNPACVGCY

SEQ ID NO: 5583 - protein, 13 aa, Artificial Sequence
  Synthetically generated peptide
CEWCSNPACVACY

SEQ ID NO: 5584 - protein, 13 aa, Artificial Sequence
  Synthetically generated peptide
CEWCSNPACGGCY

SEQ ID NO: 5585 - protein, 13 aa, Artificial Sequence
  Synthetically generated peptide
CEWCSNPACGACY

SEQ ID NO: 5586 - protein, 13 aa, Artificial Sequence
  Synthetically generated peptide
CEWCSNPTCTGCY

SEQ ID NO: 5587 - protein, 13 aa, Artificial Sequence
  Synthetically generated peptide
CEWCSNPTCTACY

SEQ ID NO: 5588 - protein, 13 aa, Artificial Sequence
  Synthetically generated peptide
CEWCSNPTCVGCY

SEQ ID NO: 5589 - protein, 13 aa, Artificial Sequence
  Synthetically generated peptide
CEWCSNPTCVACY

SEQ ID NO: 5590 - protein, 13 aa, Artificial Sequence
  Synthetically generated peptide
CEWCSNPTCGGCY

SEQ ID NO: 5591 - protein, 13 aa, Artificial Sequence
  Synthetically generated peptide
CEWCSNPTCGACY

SEQ ID NO: 5592 - protein, 13 aa, Artificial Sequence
  Synthetically generated peptide
CEWCSNGACTGCY

SEQ ID NO: 5593 - protein, 13 aa, Artificial Sequence
  Synthetically generated peptide
CEWCSNGACTACY

SEQ ID NO: 5594 - protein, 13 aa, Artificial Sequence
  Synthetically generated peptide
CEWCSNGACVGCY

SEQ ID NO: 5595 - protein, 13 aa, Artificial Sequence
  Synthetically generated peptide
CEWCSNGACVACY

SEQ ID NO: 5596 - protein, 13 aa, Artificial Sequence
  Synthetically generated peptide
CEWCSNGACGGCY

SEQ ID NO: 5597 - protein, 13 aa, Artificial Sequence
  Synthetically generated peptide
CEWCSNGACGACY

SEQ ID NO: 5598 - protein, 13 aa, Artificial Sequence
  Synthetically generated peptide
CEWCSNGTCTGCY

SEQ ID NO: 5599 - protein, 13 aa, Artificial Sequence
  Synthetically generated peptide
CEWCSNGTCTACY

SEQ ID NO: 5600 - protein, 13 aa, Artificial Sequence
  Synthetically generated peptide
CEWCSNGTCVGCY

SEQ ID NO: 5601 - protein, 13 aa, Artificial Sequence
  Synthetically generated peptide
CEWCSNGTCVACY

SEQ ID NO: 5602 - protein, 13 aa, Artificial Sequence
  Synthetically generated peptide
CEWCSNGTCGGCY

SEQ ID NO: 5603 - protein, 13 aa, Artificial Sequence
  Synthetically generated peptide
CEWCSNGTCGACY

SEQ ID NO: 5604 - protein, 13 aa, Artificial Sequence
  Synthetically generated peptide
CEWCTNPACTGCY

SEQ ID NO: 5605 - protein, 13 aa, Artificial Sequence
  Synthetically generated peptide
CEWCTNPACTACY

SEQ ID NO: 5606 - protein, 13 aa, Artificial Sequence
  Synthetically generated peptide
CEWCTNPACVGCY

SEQ ID NO: 5607 - protein, 13 aa, Artificial Sequence
  Synthetically generated peptide
CEWCTNPACVACY

SEQ ID NO: 5608 - protein, 13 aa, Artificial Sequence
  Synthetically generated peptide
CEWCTNPACGGCY

SEQ ID NO: 5609 - protein, 13 aa, Artificial Sequence
  Synthetically generated peptide
CEWCTNPACGACY

SEQ ID NO: 5610 - protein, 13 aa, Artificial Sequence
  Synthetically generated peptide
CEWCTNPTCTGCY

SEQ ID NO: 5611 - protein, 13 aa, Artificial Sequence
  Synthetically generated peptide
CEWCTNPTCTACY

SEQ ID NO: 5612 - protein, 13 aa, Artificial Sequence
  Synthetically generated peptide
CEWCTNPTCVGCY

SEQ ID NO: 5613 - protein, 13 aa, Artificial Sequence
  Synthetically generated peptide
CEWCTNPTCVACY

SEQ ID NO: 5614 - protein, 13 aa, Artificial Sequence
  Synthetically generated peptide
CEWCTNPTCGGCY

SEQ ID NO: 5615 - protein, 13 aa, Artificial Sequence
  Synthetically generated peptide
CEWCTNPTCGACY

SEQ ID NO: 5616 - protein, 13 aa, Artificial Sequence
  Synthetically generated peptide
CEWCTNGACTGCY

SEQ ID NO: 5617 - protein, 13 aa, Artificial Sequence
  Synthetically generated peptide
CEWCTNGACTACY

SEQ ID NO: 5618 - protein, 13 aa, Artificial Sequence
  Synthetically generated peptide
CEWCTNGACVGCY

SEQ ID NO: 5619 - protein, 13 aa, Artificial Sequence
  Synthetically generated peptide
CEWCTNGACVACY

SEQ ID NO: 5620 - protein, 13 aa, Artificial Sequence
  Synthetically generated peptide
CEWCTNGACGGCY

SEQ ID NO: 5621 - protein, 13 aa, Artificial Sequence
  Synthetically generated peptide
CEWCTNGACGACY

SEQ ID NO: 5622 - protein, 13 aa, Artificial Sequence
  Synthetically generated peptide
CEWCTNGTCTGCY

SEQ ID NO: 5623 - protein, 13 aa, Artificial Sequence
  Synthetically generated peptide
CEWCTNGTCTACY

SEQ ID NO: 5624 - protein, 13 aa, Artificial Sequence
  Synthetically generated peptide
CEWCTNGTCVGCY

SEQ ID NO: 5625 - protein, 13 aa, Artificial Sequence
  Synthetically generated peptide
CEWCTNGTCVACY

SEQ ID NO: 5626 - protein, 13 aa, Artificial Sequence
  Synthetically generated peptide
CEWCTNGTCGGCY

SEQ ID NO: 5627 - protein, 13 aa, Artificial Sequence
  Synthetically generated peptide
CEWCTNGTCGACY

SEQ ID NO: 5628 - protein, 13 aa, Artificial Sequence
  Synthetically generated peptide
CEWCWNPACTGCY

SEQ ID NO: 5629 - protein, 13 aa, Artificial Sequence
  Synthetically generated peptide
CEWCWNPACTACY

SEQ ID NO: 5630 - protein, 13 aa, Artificial Sequence
  Synthetically generated peptide
CEWCWNPACVGCY

SEQ ID NO: 5631 - protein, 13 aa, Artificial Sequence
  Synthetically generated peptide
CEWCWNPACVACY

SEQ ID NO: 5632 - protein, 13 aa, Artificial Sequence
  Synthetically generated peptide
CEWCWNPACGGCY

SEQ ID NO: 5633 - protein, 13 aa, Artificial Sequence
  Synthetically generated peptide
CEWCWNPACGACY

SEQ ID NO: 5634 - protein, 13 aa, Artificial Sequence
  Synthetically generated peptide
CEWCWNPTCTGCY

SEQ ID NO: 5635 - protein, 13 aa, Artificial Sequence
  Synthetically generated peptide
CEWCWNPTCTACY

SEQ ID NO: 5636 - protein, 13 aa, Artificial Sequence
  Synthetically generated peptide
CEWCWNPTCVGCY

SEQ ID NO: 5637 - protein, 13 aa, Artificial Sequence
  Synthetically generated peptide
CEWCWNPTCVACY

SEQ ID NO: 5638 - protein, 13 aa, Artificial Sequence
  Synthetically generated peptide
CEWCWNPTCGGCY

SEQ ID NO: 5639 - protein, 13 aa, Artificial Sequence
  Synthetically generated peptide
CEWCWNPTCGACY

SEQ ID NO: 5640 - protein, 13 aa, Artificial Sequence
  Synthetically generated peptide
CEWCWNGACTGCY

SEQ ID NO: 5641 - protein, 13 aa, Artificial Sequence
  Synthetically generated peptide
CEWCWNGACTACY

SEQ ID NO: 5642 - protein, 13 aa, Artificial Sequence
  Synthetically generated peptide
CEWCWNGACVGCY

SEQ ID NO: 5643 - protein, 13 aa, Artificial Sequence
  Synthetically generated peptide
CEWCWNGACVACY

SEQ ID NO: 5644 - protein, 13 aa, Artificial Sequence
  Synthetically generated peptide
CEWCWNGACGGCY

SEQ ID NO: 5645 - protein, 13 aa, Artificial Sequence
  Synthetically generated peptide
CEWCWNGACGACY

SEQ ID NO: 5646 - protein, 13 aa, Artificial Sequence
  Synthetically generated peptide
CEWCWNGTCTGCY

SEQ ID NO: 5647 - protein, 13 aa, Artificial Sequence
  Synthetically generated peptide
CEWCWNGTCTACY

SEQ ID NO: 5648 - protein, 13 aa, Artificial Sequence
  Synthetically generated peptide
CEWCWNGTCVGCY

SEQ ID NO: 5649 - protein, 13 aa, Artificial Sequence
  Synthetically generated peptide
CEWCWNGTCVACY

SEQ ID NO: 5650 - protein, 13 aa, Artificial Sequence
  Synthetically generated peptide
CEWCWNGTCGGCY

SEQ ID NO: 5651 - protein, 13 aa, Artificial Sequence
  Synthetically generated peptide
CEWCWNGTCGACY

SEQ ID NO: 5652 - protein, 13 aa, Artificial Sequence
  Synthetically generated peptide
CEWCYNPACTGCY

SEQ ID NO: 5653 - protein, 13 aa, Artificial Sequence
  Synthetically generated peptide
CEWCYNPACTACY

SEQ ID NO: 5654 - protein, 13 aa, Artificial Sequence
  Synthetically generated peptide
CEWCYNPACVGCY

SEQ ID NO: 5655 - protein, 13 aa, Artificial Sequence
  Synthetically generated peptide
CEWCYNPACVACY

SEQ ID NO: 5656 - protein, 13 aa, Artificial Sequence
  Synthetically generated peptide
CEWCYNPACGGCY

SEQ ID NO: 5657 - protein, 13 aa, Artificial Sequence
  Synthetically generated peptide
CEWCYNPACGACY

SEQ ID NO: 5658 - protein, 13 aa, Artificial Sequence
  Synthetically generated peptide
CEWCYNPTCTGCY

SEQ ID NO: 5659 - protein, 13 aa, Artificial Sequence
  Synthetically generated peptide
CEWCYNPTCTACY

SEQ ID NO: 5660 - protein, 13 aa, Artificial Sequence
  Synthetically generated peptide
CEWCYNPTCVGCY

SEQ ID NO: 5661 - protein, 13 aa, Artificial Sequence
  Synthetically generated peptide
CEWCYNPTCVACY

SEQ ID NO: 5662 - protein, 13 aa, Artificial Sequence
  Synthetically generated peptide
CEWCYNPTCGGCY

SEQ ID NO: 5663 - protein, 13 aa, Artificial Sequence
  Synthetically generated peptide
CEWCYNPTCGACY

SEQ ID NO: 5664 - protein, 13 aa, Artificial Sequence
  Synthetically generated peptide
CEWCYNGACTGCY

SEQ ID NO: 5665 - protein, 13 aa, Artificial Sequence
  Synthetically generated peptide
CEWCYNGACTACY

SEQ ID NO: 5666 - protein, 13 aa, Artificial Sequence
  Synthetically generated peptide
CEWCYNGACVGCY

SEQ ID NO: 5667 - protein, 13 aa, Artificial Sequence
  Synthetically generated peptide
CEWCYNGACVACY

SEQ ID NO: 5668 - protein, 13 aa, Artificial Sequence
  Synthetically generated peptide
CEWCYNGACGGCY

SEQ ID NO: 5669 - protein, 13 aa, Artificial Sequence
  Synthetically generated peptide
CEWCYNGACGACY

SEQ ID NO: 5670 - protein, 13 aa, Artificial Sequence
  Synthetically generated peptide
CEWCYNGTCTGCY

SEQ ID NO: 5671 - protein, 13 aa, Artificial Sequence
  Synthetically generated peptide
CEWCYNGTCTACY

SEQ ID NO: 5672 - protein, 13 aa, Artificial Sequence
  Synthetically generated peptide
CEWCYNGTCVGCY

SEQ ID NO: 5673 - protein, 13 aa, Artificial Sequence
  Synthetically generated peptide
CEWCYNGTCVACY

SEQ ID NO: 5674 - protein, 13 aa, Artificial Sequence
  Synthetically generated peptide
CEWCYNGTCGGCY

SEQ ID NO: 5675 - protein, 13 aa, Artificial Sequence
  Synthetically generated peptide
CEWCYNGTCGACY

SEQ ID NO: 5676 - protein, 13 aa, Artificial Sequence
  Synthetically generated peptide
CEWCVNPACTGCY

SEQ ID NO: 5677 - protein, 13 aa, Artificial Sequence
  Synthetically generated peptide
CEWCVNPACTACY

SEQ ID NO: 5678 - protein, 13 aa, Artificial Sequence
  Synthetically generated peptide
CEWCVNPACVGCY

SEQ ID NO: 5679 - protein, 13 aa, Artificial Sequence
  Synthetically generated peptide
CEWCVNPACVACY

SEQ ID NO: 5680 - protein, 13 aa, Artificial Sequence
  Synthetically generated peptide
CEWCVNPACGGCY

SEQ ID NO: 5681 - protein, 13 aa, Artificial Sequence
  Synthetically generated peptide
CEWCVNPACGACY

SEQ ID NO: 5682 - protein, 13 aa, Artificial Sequence
  Synthetically generated peptide
CEWCVNPTCTGCY

SEQ ID NO: 5683 - protein, 13 aa, Artificial Sequence
  Synthetically generated peptide
CEWCVNPTCTACY

SEQ ID NO: 5684 - protein, 13 aa, Artificial Sequence
  Synthetically generated peptide
CEWCVNPTCVGCY

SEQ ID NO: 5685 - protein, 13 aa, Artificial Sequence
  Synthetically generated peptide
CEWCVNPTCVACY

SEQ ID NO: 5686 - protein, 13 aa, Artificial Sequence
  Synthetically generated peptide
CEWCVNPTCGGCY

SEQ ID NO: 5687 - protein, 13 aa, Artificial Sequence
  Synthetically generated peptide
CEWCVNPTCGACY

SEQ ID NO: 5688 - protein, 13 aa, Artificial Sequence
  Synthetically generated peptide
CEWCVNGACTGCY

SEQ ID NO: 5689 - protein, 13 aa, Artificial Sequence
  Synthetically generated peptide
CEWCVNGACTACY

SEQ ID NO: 5690 - protein, 13 aa, Artificial Sequence
  Synthetically generated peptide
CEWCVNGACVGCY

SEQ ID NO: 5691 - protein, 13 aa, Artificial Sequence
  Synthetically generated peptide
CEWCVNGACVACY

SEQ ID NO: 5692 - protein, 13 aa, Artificial Sequence
  Synthetically generated peptide
CEWCVNGACGGCY

SEQ ID NO: 5693 - protein, 13 aa, Artificial Sequence
  Synthetically generated peptide
CEWCVNGACGACY

SEQ ID NO: 5694 - protein, 13 aa, Artificial Sequence
  Synthetically generated peptide
CEWCVNGTCTGCY

SEQ ID NO: 5695 - protein, 13 aa, Artificial Sequence
  Synthetically generated peptide
CEWCVNGTCTACY

SEQ ID NO: 5696 - protein, 13 aa, Artificial Sequence
  Synthetically generated peptide
CEWCVNGTCVGCY

SEQ ID NO: 5697 - protein, 13 aa, Artificial Sequence
  Synthetically generated peptide
CEWCVNGTCVACY

SEQ ID NO: 5698 - protein, 13 aa, Artificial Sequence
  Synthetically generated peptide
CEWCVNGTCGGCY

SEQ ID NO: 5699 - protein, 13 aa, Artificial Sequence
  Synthetically generated peptide
CEWCVNGTCGACY

SEQ ID NO: 5700 - protein, 12 aa, Artificial Sequence
  Synthetically generated peptide
CEWCNPACTGCY

SEQ ID NO: 5701 - protein, 12 aa, Artificial Sequence
  Synthetically generated peptide
CEWCNPACTACY

SEQ ID NO: 5702 - protein, 12 aa, Artificial Sequence
  Synthetically generated peptide
CEWCNPACVGCY

SEQ ID NO: 5703 - protein, 12 aa, Artificial Sequence
  Synthetically generated peptide
CEWCNPACVACY

SEQ ID NO: 5704 - protein, 12 aa, Artificial Sequence
  Synthetically generated peptide
CEWCNPACGGCY

SEQ ID NO: 5705 - protein, 12 aa, Artificial Sequence
  Synthetically generated peptide
CEWCNPACGACY

SEQ ID NO: 5706 - protein, 12 aa, Artificial Sequence
  Synthetically generated peptide
CEWCNPTCTGCY

SEQ ID NO: 5707 - protein, 12 aa, Artificial Sequence
  Synthetically generated peptide
CEWCNPTCTACY

SEQ ID NO: 5708 - protein, 12 aa, Artificial Sequence
  Synthetically generated peptide
CEWCNPTCVGCY

SEQ ID NO: 5709 - protein, 12 aa, Artificial Sequence
  Synthetically generated peptide
CEWCNPTCVACY

SEQ ID NO: 5710 - protein, 12 aa, Artificial Sequence
  Synthetically generated peptide
CEWCNPTCGGCY

SEQ ID NO: 5711 - protein, 12 aa, Artificial Sequence
  Synthetically generated peptide
CEWCNPTCGACY

SEQ ID NO: 5712 - protein, 12 aa, Artificial Sequence
  Synthetically generated peptide
CEWCNGACTGCY

SEQ ID NO: 5713 - protein, 12 aa, Artificial Sequence
  Synthetically generated peptide
CEWCNGACTACY

SEQ ID NO: 5714 - protein, 12 aa, Artificial Sequence
  Synthetically generated peptide
CEWCNGACVGCY

SEQ ID NO: 5715 - protein, 12 aa, Artificial Sequence
  Synthetically generated peptide
CEWCNGACVACY

SEQ ID NO: 5716 - protein, 12 aa, Artificial Sequence
  Synthetically generated peptide
CEWCNGACGGCY

SEQ ID NO: 5717 - protein, 12 aa, Artificial Sequence
  Synthetically generated peptide
CEWCNGACGACY

SEQ ID NO: 5718 - protein, 12 aa, Artificial Sequence
  Synthetically generated peptide
CEWCNGTCTGCY

SEQ ID NO: 5719 - protein, 12 aa, Artificial Sequence
  Synthetically generated peptide
CEWCNGTCTACY

SEQ ID NO: 5720 - protein, 12 aa, Artificial Sequence
  Synthetically generated peptide
CEWCNGTCVGCY

SEQ ID NO: 5721 - protein, 12 aa, Artificial Sequence
  Synthetically generated peptide
CEWCNGTCVACY

SEQ ID NO: 5722 - protein, 12 aa, Artificial Sequence
  Synthetically generated peptide
CEWCNGTCGGCY

SEQ ID NO: 5723 - protein, 12 aa, Artificial Sequence
  Synthetically generated peptide
CEWCNGTCGACY

SEQ ID NO: 5724 - protein, 13 aa, Artificial Sequence
  Synthetically generated peptide
CEFCANPACTGCY

SEQ ID NO: 5725 - protein, 13 aa, Artificial Sequence
  Synthetically generated peptide
CEFCANPACTACY

SEQ ID NO: 5726 - protein, 13 aa, Artificial Sequence
  Synthetically generated peptide
CEFCANPACVGCY

SEQ ID NO: 5727 - protein, 13 aa, Artificial Sequence
  Synthetically generated peptide
CEFCANPACVACY

SEQ ID NO: 5728 - protein, 13 aa, Artificial Sequence
  Synthetically generated peptide
CEFCANPACGGCY

SEQ ID NO: 5729 - protein, 13 aa, Artificial Sequence
  Synthetically generated peptide
CEFCANPACGACY

SEQ ID NO: 5730 - protein, 13 aa, Artificial Sequence
  Synthetically generated peptide
CEFCANPTCTGCY

SEQ ID NO: 5731 - protein, 13 aa, Artificial Sequence
  Synthetically generated peptide
CEFCANPTCTACY

SEQ ID NO: 5732 - protein, 13 aa, Artificial Sequence
  Synthetically generated peptide
CEFCANPTCVGCY

SEQ ID NO: 5733 - protein, 13 aa, Artificial Sequence
  Synthetically generated peptide
CEFCANPTCVACY

SEQ ID NO: 5734 - protein, 13 aa, Artificial Sequence
  Synthetically generated peptide
CEFCANPTCGGCY

SEQ ID NO: 5735 - protein, 13 aa, Artificial Sequence
  Synthetically generated peptide
CEFCANPTCGACY

SEQ ID NO: 5736 - protein, 13 aa, Artificial Sequence
  Synthetically generated peptide
CEFCANGACTGCY

SEQ ID NO: 5737 - protein, 13 aa, Artificial Sequence
  Synthetically generated peptide
CEFCANGACTACY

SEQ ID NO: 5738 - protein, 13 aa, Artificial Sequence
  Synthetically generated peptide
CEFCANGACVGCY

SEQ ID NO: 5739 - protein, 13 aa, Artificial Sequence
  Synthetically generated peptide
CEFCANGACVACY

SEQ ID NO: 5740 - protein, 13 aa, Artificial Sequence
  Synthetically generated peptide
CEFCANGACGGCY

SEQ ID NO: 5741 - protein, 13 aa, Artificial Sequence
  Synthetically generated peptide
CEFCANGACGACY

SEQ ID NO: 5742 - protein, 13 aa, Artificial Sequence
  Synthetically generated peptide
CEFCANGTCTGCY

SEQ ID NO: 5743 - protein, 13 aa, Artificial Sequence
  Synthetically generated peptide
CEFCANGTCTACY

SEQ ID NO: 5744 - protein, 13 aa, Artificial Sequence
  Synthetically generated peptide
CEFCANGTCVGCY

SEQ ID NO: 5745 - protein, 13 aa, Artificial Sequence
  Synthetically generated peptide
CEFCANGTCVACY

SEQ ID NO: 5746 - protein, 13 aa, Artificial Sequence
  Synthetically generated peptide
CEFCANGTCGGCY

SEQ ID NO: 5747 - protein, 13 aa, Artificial Sequence
  Synthetically generated peptide
CEFCANGTCGACY

SEQ ID NO: 5748 - protein, 13 aa, Artificial Sequence
  Synthetically generated peptide
CEFCRNPACTGCY

SEQ ID NO: 5749 - protein, 13 aa, Artificial Sequence
  Synthetically generated peptide
CEFCRNPACTACY

SEQ ID NO: 5750 - protein, 13 aa, Artificial Sequence
  Synthetically generated peptide
CEFCRNPACVGCY

SEQ ID NO: 5751 - protein, 13 aa, Artificial Sequence
  Synthetically generated peptide
CEFCRNPACVACY

SEQ ID NO: 5752 - protein, 13 aa, Artificial Sequence
  Synthetically generated peptide
CEFCRNPACGGCY

SEQ ID NO: 5753 - protein, 13 aa, Artificial Sequence
  Synthetically generated peptide
CEFCRNPACGACY

SEQ ID NO: 5754 - protein, 13 aa, Artificial Sequence
  Synthetically generated peptide
CEFCRNPTCTGCY

SEQ ID NO: 5755 - protein, 13 aa, Artificial Sequence
  Synthetically generated peptide
CEFCRNPTCTACY

SEQ ID NO: 5756 - protein, 13 aa, Artificial Sequence
  Synthetically generated peptide
CEFCRNPTCVGCY

SEQ ID NO: 5757 - protein, 13 aa, Artificial Sequence
  Synthetically generated peptide
CEFCRNPTCVACY

SEQ ID NO: 5758 - protein, 13 aa, Artificial Sequence
  Synthetically generated peptide
CEFCRNPTCGGCY

SEQ ID NO: 5759 - protein, 13 aa, Artificial Sequence
  Synthetically generated peptide
CEFCRNPTCGACY

SEQ ID NO: 5760 - protein, 13 aa, Artificial Sequence
  Synthetically generated peptide
CEFCRNGACTGCY

SEQ ID NO: 5761 - protein, 13 aa, Artificial Sequence
  Synthetically generated peptide
CEFCRNGACTACY

SEQ ID NO: 5762 - protein, 13 aa, Artificial Sequence
  Synthetically generated peptide
CEFCRNGACVGCY

SEQ ID NO: 5763 - protein, 13 aa, Artificial Sequence
  Synthetically generated peptide
CEFCRNGACVACY

SEQ ID NO: 5764 - protein, 13 aa, Artificial Sequence
  Synthetically generated peptide
CEFCRNGACGGCY

SEQ ID NO: 5765 - protein, 13 aa, Artificial Sequence
  Synthetically generated peptide
CEFCRNGACGACY

SEQ ID NO: 5766 - protein, 13 aa, Artificial Sequence
  Synthetically generated peptide
CEFCRNGTCTGCY

SEQ ID NO: 5767 - protein, 13 aa, Artificial Sequence
  Synthetically generated peptide
CEFCRNGTCTACY

SEQ ID NO: 5768 - protein, 13 aa, Artificial Sequence
  Synthetically generated peptide
CEFCRNGTCVGCY

SEQ ID NO: 5769 - protein, 13 aa, Artificial Sequence
  Synthetically generated peptide
CEFCRNGTCVACY

SEQ ID NO: 5770 - protein, 13 aa, Artificial Sequence
  Synthetically generated peptide
CEFCRNGTCGGCY

SEQ ID NO: 5771 - protein, 13 aa, Artificial Sequence
  Synthetically generated peptide
CEFCRNGTCGACY

SEQ ID NO: 5772 - protein, 13 aa, Artificial Sequence
  Synthetically generated peptide
CEFCNNPACTGCY

SEQ ID NO: 5773 - protein, 13 aa, Artificial Sequence
  Synthetically generated peptide
CEFCNNPACTACY

SEQ ID NO: 5774 - protein, 13 aa, Artificial Sequence
  Synthetically generated peptide
CEFCNNPACVGCY

SEQ ID NO: 5775 - protein, 13 aa, Artificial Sequence
  Synthetically generated peptide
CEFCNNPACVACY

SEQ ID NO: 5776 - protein, 13 aa, Artificial Sequence
  Synthetically generated peptide
CEFCNNPACGGCY

SEQ ID NO: 5777 - protein, 13 aa, Artificial Sequence
  Synthetically generated peptide
CEFCNNPACGACY

SEQ ID NO: 5778 - protein, 13 aa, Artificial Sequence
  Synthetically generated peptide
CEFCNNPTCTGCY

SEQ ID NO: 5779 - protein, 13 aa, Artificial Sequence
  Synthetically generated peptide
CEFCNNPTCTACY

SEQ ID NO: 5780 - protein, 13 aa, Artificial Sequence
  Synthetically generated peptide
CEFCNNPTCVGCY

SEQ ID NO: 5781 - protein, 13 aa, Artificial Sequence
  Synthetically generated peptide
CEFCNNPTCVACY

SEQ ID NO: 5782 - protein, 13 aa, Artificial Sequence
  Synthetically generated peptide
CEFCNNPTCGGCY

SEQ ID NO: 5783 - protein, 13 aa, Artificial Sequence
  Synthetically generated peptide
CEFCNNPTCGACY

SEQ ID NO: 5784 - protein, 13 aa, Artificial Sequence
  Synthetically generated peptide
CEFCNNGACTGCY

SEQ ID NO: 5785 - protein, 13 aa, Artificial Sequence
  Synthetically generated peptide
CEFCNNGACTACY

SEQ ID NO: 5786 - protein, 13 aa, Artificial Sequence
  Synthetically generated peptide
CEFCNNGACVGCY

SEQ ID NO: 5787 - protein, 13 aa, Artificial Sequence
  Synthetically generated peptide
CEFCNNGACVACY

SEQ ID NO: 5788 - protein, 13 aa, Artificial Sequence
  Synthetically generated peptide
CEFCNNGACGGCY

SEQ ID NO: 5789 - protein, 13 aa, Artificial Sequence
  Synthetically generated peptide
CEFCNNGACGACY

SEQ ID NO: 5790 - protein, 13 aa, Artificial Sequence
  Synthetically generated peptide
CEFCNNGTCTGCY

SEQ ID NO: 5791 - protein, 13 aa, Artificial Sequence
  Synthetically generated peptide
CEFCNNGTCTACY

SEQ ID NO: 5792 - protein, 13 aa, Artificial Sequence
  Synthetically generated peptide
CEFCNNGTCVGCY

SEQ ID NO: 5793 - protein, 13 aa, Artificial Sequence
  Synthetically generated peptide
CEFCNNGTCVACY

SEQ ID NO: 5794 - protein, 13 aa, Artificial Sequence
  Synthetically generated peptide
CEFCNNGTCGGCY

SEQ ID NO: 5795 - protein, 13 aa, Artificial Sequence
  Synthetically generated peptide
CEFCNNGTCGACY

SEQ ID NO: 5796 - protein, 13 aa, Artificial Sequence
  Synthetically generated peptide
CEFCDNPACTGCY

SEQ ID NO: 5797 - protein, 13 aa, Artificial Sequence
  Synthetically generated peptide
CEFCDNPACTACY

SEQ ID NO: 5798 - protein, 13 aa, Artificial Sequence
  Synthetically generated peptide
CEFCDNPACVGCY

SEQ ID NO: 5799 - protein, 13 aa, Artificial Sequence
  Synthetically generated peptide
CEFCDNPACVACY

SEQ ID NO: 5800 - protein, 13 aa, Artificial Sequence
  Synthetically generated peptide
CEFCDNPACGGCY

SEQ ID NO: 5801 - protein, 13 aa, Artificial Sequence
  Synthetically generated peptide
CEFCDNPACGACY

SEQ ID NO: 5802 - protein, 13 aa, Artificial Sequence
  Synthetically generated peptide
CEFCDNPTCTGCY

SEQ ID NO: 5803 - protein, 13 aa, Artificial Sequence
  Synthetically generated peptide
CEFCDNPTCTACY

SEQ ID NO: 5804 - protein, 13 aa, Artificial Sequence
  Synthetically generated peptide
CEFCDNPTCVGCY

SEQ ID NO: 5805 - protein, 13 aa, Artificial Sequence
  Synthetically generated peptide
CEFCDNPTCVACY

SEQ ID NO: 5806 - protein, 13 aa, Artificial Sequence
  Synthetically generated peptide
CEFCDNPTCGGCY

SEQ ID NO: 5807 - protein, 13 aa, Artificial Sequence
  Synthetically generated peptide
CEFCDNPTCGACY

SEQ ID NO: 5808 - protein, 13 aa, Artificial Sequence
  Synthetically generated peptide
CEFCDNGACTGCY

SEQ ID NO: 5809 - protein, 13 aa, Artificial Sequence
  Synthetically generated peptide
CEFCDNGACTACY

SEQ ID NO: 5810 - protein, 13 aa, Artificial Sequence
  Synthetically generated peptide
CEFCDNGACVGCY

SEQ ID NO: 5811 - protein, 13 aa, Artificial Sequence
  Synthetically generated peptide
CEFCDNGACVACY

SEQ ID NO: 5812 - protein, 13 aa, Artificial Sequence
  Synthetically generated peptide
CEFCDNGACGGCY

SEQ ID NO: 5813 - protein, 13 aa, Artificial Sequence
  Synthetically generated peptide
CEFCDNGACGACY

SEQ ID NO: 5814 - protein, 13 aa, Artificial Sequence
  Synthetically generated peptide
CEFCDNGTCTGCY

SEQ ID NO: 5815 - protein, 13 aa, Artificial Sequence
  Synthetically generated peptide
CEFCDNGTCTACY

SEQ ID NO: 5816 - protein, 13 aa, Artificial Sequence
  Synthetically generated peptide
CEFCDNGTCVGCY

SEQ ID NO: 5817 - protein, 13 aa, Artificial Sequence
  Synthetically generated peptide
CEFCDNGTCVACY

SEQ ID NO: 5818 - protein, 13 aa, Artificial Sequence
  Synthetically generated peptide
CEFCDNGTCGGCY

SEQ ID NO: 5819 - protein, 13 aa, Artificial Sequence
  Synthetically generated peptide
CEFCDNGTCGACY

SEQ ID NO: 5820 - protein, 13 aa, Artificial Sequence
  Synthetically generated peptide
CEFCQNPACTGCY

SEQ ID NO: 5821 - protein, 13 aa, Artificial Sequence
  Synthetically generated peptide
CEFCQNPACTACY

SEQ ID NO: 5822 - protein, 13 aa, Artificial Sequence
  Synthetically generated peptide
CEFCQNPACVGCY

SEQ ID NO: 5823 - protein, 13 aa, Artificial Sequence
  Synthetically generated peptide
CEFCQNPACVACY

SEQ ID NO: 5824 - protein, 13 aa, Artificial Sequence
  Synthetically generated peptide
CEFCQNPACGGCY

SEQ ID NO: 5825 - protein, 13 aa, Artificial Sequence
  Synthetically generated peptide
CEFCQNPACGACY

SEQ ID NO: 5826 - protein, 13 aa, Artificial Sequence
  Synthetically generated peptide
CEFCQNPTCTGCY

SEQ ID NO: 5827 - protein, 13 aa, Artificial Sequence
  Synthetically generated peptide
CEFCQNPTCTACY

SEQ ID NO: 5828 - protein, 13 aa, Artificial Sequence
  Synthetically generated peptide
CEFCQNPTCVGCY

SEQ ID NO: 5829 - protein, 13 aa, Artificial Sequence
  Synthetically generated peptide
CEFCQNPTCVACY

SEQ ID NO: 5830 - protein, 13 aa, Artificial Sequence
  Synthetically generated peptide
CEFCQNPTCGGCY

SEQ ID NO: 5831 - protein, 13 aa, Artificial Sequence
  Synthetically generated peptide
CEFCQNPTCGACY

SEQ ID NO: 5832 - protein, 13 aa, Artificial Sequence
  Synthetically generated peptide
CEFCQNGACTGCY

SEQ ID NO: 5833 - protein, 13 aa, Artificial Sequence
  Synthetically generated peptide
CEFCQNGACTACY

SEQ ID NO: 5834 - protein, 13 aa, Artificial Sequence
  Synthetically generated peptide
CEFCQNGACVGCY

SEQ ID NO: 5835 - protein, 13 aa, Artificial Sequence
  Synthetically generated peptide
CEFCQNGACVACY

SEQ ID NO: 5836 - protein, 13 aa, Artificial Sequence
  Synthetically generated peptide
CEFCQNGACGGCY

SEQ ID NO: 5837 - protein, 13 aa, Artificial Sequence
  Synthetically generated peptide
CEFCQNGACGACY

SEQ ID NO: 5838 - protein, 13 aa, Artificial Sequence
  Synthetically generated peptide
CEFCQNGTCTGCY

SEQ ID NO: 5839 - protein, 13 aa, Artificial Sequence
  Synthetically generated peptide
CEFCQNGTCTACY

SEQ ID NO: 5840 - protein, 13 aa, Artificial Sequence
  Synthetically generated peptide
CEFCQNGTCVGCY

SEQ ID NO: 5841 - protein, 13 aa, Artificial Sequence
  Synthetically generated peptide
CEFCQNGTCVACY

SEQ ID NO: 5842 - protein, 13 aa, Artificial Sequence
  Synthetically generated peptide
CEFCQNGTCGGCY

SEQ ID NO: 5843 - protein, 13 aa, Artificial Sequence
  Synthetically generated peptide
CEFCQNGTCGACY

SEQ ID NO: 5844 - protein, 13 aa, Artificial Sequence
  Synthetically generated peptide
CEFCENPACTGCY

SEQ ID NO: 5845 - protein, 13 aa, Artificial Sequence
  Synthetically generated peptide
CEFCENPACTACY

SEQ ID NO: 5846 - protein, 13 aa, Artificial Sequence
  Synthetically generated peptide
CEFCENPACVGCY

SEQ ID NO: 5847 - protein, 13 aa, Artificial Sequence
  Synthetically generated peptide
CEFCENPACVACY

SEQ ID NO: 5848 - protein, 13 aa, Artificial Sequence
  Synthetically generated peptide
CEFCENPACGGCY

SEQ ID NO: 5849 - protein, 13 aa, Artificial Sequence
  Synthetically generated peptide
CEFCENPACGACY

SEQ ID NO: 5850 - protein, 13 aa, Artificial Sequence
  Synthetically generated peptide
CEFCENPTCTGCY

SEQ ID NO: 5851 - protein, 13 aa, Artificial Sequence
  Synthetically generated peptide
CEFCENPTCTACY

SEQ ID NO: 5852 - protein, 13 aa, Artificial Sequence
  Synthetically generated peptide
CEFCENPTCVGCY

SEQ ID NO: 5853 - protein, 13 aa, Artificial Sequence
  Synthetically generated peptide
CEFCENPTCVACY

SEQ ID NO: 5854 - protein, 13 aa, Artificial Sequence
  Synthetically generated peptide
CEFCENPTCGGCY

SEQ ID NO: 5855 - protein, 13 aa, Artificial Sequence
  Synthetically generated peptide
CEFCENPTCGACY

SEQ ID NO: 5856 - protein, 13 aa, Artificial Sequence
  Synthetically generated peptide
CEFCENGACTGCY

SEQ ID NO: 5857 - protein, 13 aa, Artificial Sequence
  Synthetically generated peptide
CEFCENGACTACY

SEQ ID NO: 5858 - protein, 13 aa, Artificial Sequence
  Synthetically generated peptide
CEFCENGACVGCY

SEQ ID NO: 5859 - protein, 13 aa, Artificial Sequence
  Synthetically generated peptide
CEFCENGACVACY

SEQ ID NO: 5860 - protein, 13 aa, Artificial Sequence
  Synthetically generated peptide
CEFCENGACGGCY

SEQ ID NO: 5861 - protein, 13 aa, Artificial Sequence
  Synthetically generated peptide
CEFCENGACGACY

SEQ ID NO: 5862 - protein, 13 aa, Artificial Sequence
  Synthetically generated peptide
CEFCENGTCTGCY

SEQ ID NO: 5863 - protein, 13 aa, Artificial Sequence
  Synthetically generated peptide
CEFCENGTCTACY

SEQ ID NO: 5864 - protein, 13 aa, Artificial Sequence
  Synthetically generated peptide
CEFCENGTCVGCY

SEQ ID NO: 5865 - protein, 13 aa, Artificial Sequence
  Synthetically generated peptide
CEFCENGTCVACY

SEQ ID NO: 5866 - protein, 13 aa, Artificial Sequence
  Synthetically generated peptide
CEFCENGTCGGCY

SEQ ID NO: 5867 - protein, 13 aa, Artificial Sequence
  Synthetically generated peptide
CEFCENGTCGACY

SEQ ID NO: 5868 - protein, 13 aa, Artificial Sequence
  Synthetically generated peptide
CEFCGNPACTGCY

SEQ ID NO: 5869 - protein, 13 aa, Artificial Sequence
  Synthetically generated peptide
CEFCGNPACTACY

SEQ ID NO: 5870 - protein, 13 aa, Artificial Sequence
  Synthetically generated peptide
CEFCGNPACVGCY

SEQ ID NO: 5871 - protein, 13 aa, Artificial Sequence
  Synthetically generated peptide
CEFCGNPACVACY

SEQ ID NO: 5872 - protein, 13 aa, Artificial Sequence
  Synthetically generated peptide
CEFCGNPACGGCY

SEQ ID NO: 5873 - protein, 13 aa, Artificial Sequence
  Synthetically generated peptide
CEFCGNPACGACY

SEQ ID NO: 5874 - protein, 13 aa, Artificial Sequence
  Synthetically generated peptide
CEFCGNPTCTGCY

SEQ ID NO: 5875 - protein, 13 aa, Artificial Sequence
  Synthetically generated peptide
CEFCGNPTCTACY

SEQ ID NO: 5876 - protein, 13 aa, Artificial Sequence
  Synthetically generated peptide
CEFCGNPTCVGCY

SEQ ID NO: 5877 - protein, 13 aa, Artificial Sequence
  Synthetically generated peptide
CEFCGNPTCVACY

SEQ ID NO: 5878 - protein, 13 aa, Artificial Sequence
  Synthetically generated peptide
CEFCGNPTCGGCY

SEQ ID NO: 5879 - protein, 13 aa, Artificial Sequence
  Synthetically generated peptide
CEFCGNPTCGACY

SEQ ID NO: 5880 - protein, 13 aa, Artificial Sequence
  Synthetically generated peptide
CEFCGNGACTGCY

SEQ ID NO: 5881 - protein, 13 aa, Artificial Sequence
  Synthetically generated peptide
CEFCGNGACTACY

SEQ ID NO: 5882 - protein, 13 aa, Artificial Sequence
  Synthetically generated peptide
CEFCGNGACVGCY

SEQ ID NO: 5883 - protein, 13 aa, Artificial Sequence
  Synthetically generated peptide
CEFCGNGACVACY

SEQ ID NO: 5884 - protein, 13 aa, Artificial Sequence
  Synthetically generated peptide
CEFCGNGACGGCY

SEQ ID NO: 5885 - protein, 13 aa, Artificial Sequence
  Synthetically generated peptide
CEFCGNGACGACY

SEQ ID NO: 5886 - protein, 13 aa, Artificial Sequence
  Synthetically generated peptide
CEFCGNGTCTGCY

SEQ ID NO: 5887 - protein, 13 aa, Artificial Sequence
  Synthetically generated peptide
CEFCGNGTCTACY

SEQ ID NO: 5888 - protein, 13 aa, Artificial Sequence
  Synthetically generated peptide
CEFCGNGTCVGCY

SEQ ID NO: 5889 - protein, 13 aa, Artificial Sequence
  Synthetically generated peptide
CEFCGNGTCVACY

SEQ ID NO: 5890 - protein, 13 aa, Artificial Sequence
  Synthetically generated peptide
CEFCGNGTCGGCY

SEQ ID NO: 5891 - protein, 13 aa, Artificial Sequence
  Synthetically generated peptide
CEFCGNGTCGACY

SEQ ID NO: 5892 - protein, 13 aa, Artificial Sequence
  Synthetically generated peptide
CEFCHNPACTGCY

SEQ ID NO: 5893 - protein, 13 aa, Artificial Sequence
  Synthetically generated peptide
CEFCHNPACTACY

SEQ ID NO: 5894 - protein, 13 aa, Artificial Sequence
  Synthetically generated peptide
CEFCHNPACVGCY

SEQ ID NO: 5895 - protein, 13 aa, Artificial Sequence
  Synthetically generated peptide
CEFCHNPACVACY

SEQ ID NO: 5896 - protein, 13 aa, Artificial Sequence
  Synthetically generated peptide
CEFCHNPACGGCY

SEQ ID NO: 5897 - protein, 13 aa, Artificial Sequence
  Synthetically generated peptide
CEFCHNPACGACY

SEQ ID NO: 5898 - protein, 13 aa, Artificial Sequence
  Synthetically generated peptide
CEFCHNPTCTGCY

SEQ ID NO: 5899 - protein, 13 aa, Artificial Sequence
  Synthetically generated peptide
CEFCHNPTCTACY

SEQ ID NO: 5900 - protein, 13 aa, Artificial Sequence
  Synthetically generated peptide
CEFCHNPTCVGCY

SEQ ID NO: 5901 - protein, 13 aa, Artificial Sequence
  Synthetically generated peptide
CEFCHNPTCVACY

SEQ ID NO: 5902 - protein, 13 aa, Artificial Sequence
  Synthetically generated peptide
CEFCHNPTCGGCY

SEQ ID NO: 5903 - protein, 13 aa, Artificial Sequence
  Synthetically generated peptide
CEFCHNPTCGACY

SEQ ID NO: 5904 - protein, 13 aa, Artificial Sequence
  Synthetically generated peptide
CEFCHNGACTGCY

SEQ ID NO: 5905 - protein, 13 aa, Artificial Sequence
  Synthetically generated peptide
CEFCHNGACTACY

SEQ ID NO: 5906 - protein, 13 aa, Artificial Sequence
  Synthetically generated peptide
CEFCHNGACVGCY

SEQ ID NO: 5907 - protein, 13 aa, Artificial Sequence
  Synthetically generated peptide
CEFCHNGACVACY

SEQ ID NO: 5908 - protein, 13 aa, Artificial Sequence
  Synthetically generated peptide
CEFCHNGACGGCY

SEQ ID NO: 5909 - protein, 13 aa, Artificial Sequence
  Synthetically generated peptide
CEFCHNGACGACY

SEQ ID NO: 5910 - protein, 13 aa, Artificial Sequence
  Synthetically generated peptide
CEFCHNGTCTGCY

SEQ ID NO: 5911 - protein, 13 aa, Artificial Sequence
  Synthetically generated peptide
CEFCHNGTCTACY

SEQ ID NO: 5912 - protein, 13 aa, Artificial Sequence
  Synthetically generated peptide
CEFCHNGTCVGCY

SEQ ID NO: 5913 - protein, 13 aa, Artificial Sequence
  Synthetically generated peptide
CEFCHNGTCVACY

SEQ ID NO: 5914 - protein, 13 aa, Artificial Sequence
  Synthetically generated peptide
CEFCHNGTCGGCY

SEQ ID NO: 5915 - protein, 13 aa, Artificial Sequence
  Synthetically generated peptide
CEFCHNGTCGACY

SEQ ID NO: 5916 - protein, 13 aa, Artificial Sequence
  Synthetically generated peptide
CEFCINPACTGCY

SEQ ID NO: 5917 - protein, 13 aa, Artificial Sequence
  Synthetically generated peptide
CEFCINPACTACY

SEQ ID NO: 5918 - protein, 13 aa, Artificial Sequence
  Synthetically generated peptide
CEFCINPACVGCY

SEQ ID NO: 5919 - protein, 13 aa, Artificial Sequence
  Synthetically generated peptide
CEFCINPACVACY

SEQ ID NO: 5920 - protein, 13 aa, Artificial Sequence
  Synthetically generated peptide
CEFCINPACGGCY

SEQ ID NO: 5921 - protein, 13 aa, Artificial Sequence
  Synthetically generated peptide
CEFCINPACGACY

SEQ ID NO: 5922 - protein, 13 aa, Artificial Sequence
  Synthetically generated peptide
CEFCINPTCTGCY

SEQ ID NO: 5923 - protein, 13 aa, Artificial Sequence
  Synthetically generated peptide
CEFCINPTCTACY

SEQ ID NO: 5924 - protein, 13 aa, Artificial Sequence
  Synthetically generated peptide
CEFCINPTCVGCY

SEQ ID NO: 5925 - protein, 13 aa, Artificial Sequence
  Synthetically generated peptide
CEFCINPTCVACY

SEQ ID NO: 5926 - protein, 13 aa, Artificial Sequence
  Synthetically generated peptide
CEFCINPTCGGCY

SEQ ID NO: 5927 - protein, 13 aa, Artificial Sequence
  Synthetically generated peptide
CEFCINPTCGACY

SEQ ID NO: 5928 - protein, 13 aa, Artificial Sequence
  Synthetically generated peptide
CEFCINGACTGCY

SEQ ID NO: 5929 - protein, 13 aa, Artificial Sequence
  Synthetically generated peptide
CEFCINGACTACY

SEQ ID NO: 5930 - protein, 13 aa, Artificial Sequence
  Synthetically generated peptide
CEFCINGACVGCY

SEQ ID NO: 5931 - protein, 13 aa, Artificial Sequence
  Synthetically generated peptide
CEFCINGACVACY

SEQ ID NO: 5932 - protein, 13 aa, Artificial Sequence
  Synthetically generated peptide
CEFCINGACGGCY

SEQ ID NO: 5933 - protein, 13 aa, Artificial Sequence
  Synthetically generated peptide
CEFCINGACGACY

SEQ ID NO: 5934 - protein, 13 aa, Artificial Sequence
  Synthetically generated peptide
CEFCINGTCTGCY

SEQ ID NO: 5935 - protein, 13 aa, Artificial Sequence
  Synthetically generated peptide
CEFCINGTCTACY

SEQ ID NO: 5936 - protein, 13 aa, Artificial Sequence
  Synthetically generated peptide
CEFCINGTCVGCY

SEQ ID NO: 5937 - protein, 13 aa, Artificial Sequence
  Synthetically generated peptide
CEFCINGTCVACY

SEQ ID NO: 5938 - protein, 13 aa, Artificial Sequence
  Synthetically generated peptide
CEFCINGTCGGCY

SEQ ID NO: 5939 - protein, 13 aa, Artificial Sequence
  Synthetically generated peptide
CEFCINGTCGACY

SEQ ID NO: 5940 - protein, 13 aa, Artificial Sequence
  Synthetically generated peptide
CEFCLNPACTGCY

SEQ ID NO: 5941 - protein, 13 aa, Artificial Sequence
  Synthetically generated peptide
CEFCLNPACTACY

SEQ ID NO: 5942 - protein, 13 aa, Artificial Sequence
  Synthetically generated peptide
CEFCLNPACVGCY

SEQ ID NO: 5943 - protein, 13 aa, Artificial Sequence
  Synthetically generated peptide
CEFCLNPACVACY

SEQ ID NO: 5944 - protein, 13 aa, Artificial Sequence
  Synthetically generated peptide
CEFCLNPACGGCY

SEQ ID NO: 5945 - protein, 13 aa, Artificial Sequence
  Synthetically generated peptide
CEFCLNPACGACY

SEQ ID NO: 5946 - protein, 13 aa, Artificial Sequence
  Synthetically generated peptide
CEFCLNPTCTGCY

SEQ ID NO: 5947 - protein, 13 aa, Artificial Sequence
  Synthetically generated peptide
CEFCLNPTCTACY

SEQ ID NO: 5948 - protein, 13 aa, Artificial Sequence
  Synthetically generated peptide
CEFCLNPTCVGCY

SEQ ID NO: 5949 - protein, 13 aa, Artificial Sequence
  Synthetically generated peptide
CEFCLNPTCVACY

SEQ ID NO: 5950 - protein, 13 aa, Artificial Sequence
  Synthetically generated peptide
CEFCLNPTCGGCY

SEQ ID NO: 5951 - protein, 13 aa, Artificial Sequence
  Synthetically generated peptide
CEFCLNPTCGACY

SEQ ID NO: 5952 - protein, 13 aa, Artificial Sequence
  Synthetically generated peptide
CEFCLNGACTGCY

SEQ ID NO: 5953 - protein, 13 aa, Artificial Sequence
  Synthetically generated peptide
CEFCLNGACTACY

SEQ ID NO: 5954 - protein, 13 aa, Artificial Sequence
  Synthetically generated peptide
CEFCLNGACVGCY

SEQ ID NO: 5955 - protein, 13 aa, Artificial Sequence
  Synthetically generated peptide
CEFCLNGACVACY

SEQ ID NO: 5956 - protein, 13 aa, Artificial Sequence
  Synthetically generated peptide
CEFCLNGACGGCY

SEQ ID NO: 5957 - protein, 13 aa, Artificial Sequence
  Synthetically generated peptide
CEFCLNGACGACY

SEQ ID NO: 5958 - protein, 13 aa, Artificial Sequence
  Synthetically generated peptide
CEFCLNGTCTGCY

SEQ ID NO: 5959 - protein, 13 aa, Artificial Sequence
  Synthetically generated peptide
CEFCLNGTCTACY

SEQ ID NO: 5960 - protein, 13 aa, Artificial Sequence
  Synthetically generated peptide
CEFCLNGTCVGCY

SEQ ID NO: 5961 - protein, 13 aa, Artificial Sequence
  Synthetically generated peptide
CEFCLNGTCVACY

SEQ ID NO: 5962 - protein, 13 aa, Artificial Sequence
  Synthetically generated peptide
CEFCLNGTCGGCY

SEQ ID NO: 5963 - protein, 13 aa, Artificial Sequence
  Synthetically generated peptide
CEFCLNGTCGACY

SEQ ID NO: 5964 - protein, 13 aa, Artificial Sequence
  Synthetically generated peptide
CEFCKNPACTGCY

SEQ ID NO: 5965 - protein, 13 aa, Artificial Sequence
  Synthetically generated peptide
CEFCKNPACTACY

SEQ ID NO: 5966 - protein, 13 aa, Artificial Sequence
  Synthetically generated peptide
CEFCKNPACVGCY

SEQ ID NO: 5967 - protein, 13 aa, Artificial Sequence
  Synthetically generated peptide
CEFCKNPACVACY

SEQ ID NO: 5968 - protein, 13 aa, Artificial Sequence
  Synthetically generated peptide
CEFCKNPACGGCY

SEQ ID NO: 5969 - protein, 13 aa, Artificial Sequence
  Synthetically generated peptide
CEFCKNPACGACY

SEQ ID NO: 5970 - protein, 13 aa, Artificial Sequence
  Synthetically generated peptide
CEFCKNPTCTGCY

SEQ ID NO: 5971 - protein, 13 aa, Artificial Sequence
  Synthetically generated peptide
CEFCKNPTCTACY

SEQ ID NO: 5972 - protein, 13 aa, Artificial Sequence
  Synthetically generated peptide
CEFCKNPTCVGCY

SEQ ID NO: 5973 - protein, 13 aa, Artificial Sequence
  Synthetically generated peptide
CEFCKNPTCVACY

SEQ ID NO: 5974 - protein, 13 aa, Artificial Sequence
  Synthetically generated peptide
CEFCKNPTCGGCY

SEQ ID NO: 5975 - protein, 13 aa, Artificial Sequence
  Synthetically generated peptide
CEFCKNPTCGACY

SEQ ID NO: 5976 - protein, 13 aa, Artificial Sequence
  Synthetically generated peptide
CEFCKNGACTGCY

SEQ ID NO: 5977 - protein, 13 aa, Artificial Sequence
  Synthetically generated peptide
CEFCKNGACTACY

SEQ ID NO: 5978 - protein, 13 aa, Artificial Sequence
  Synthetically generated peptide
CEFCKNGACVGCY

SEQ ID NO: 5979 - protein, 13 aa, Artificial Sequence
  Synthetically generated peptide
CEFCKNGACVACY

SEQ ID NO: 5980 - protein, 13 aa, Artificial Sequence
  Synthetically generated peptide
CEFCKNGACGGCY

SEQ ID NO: 5981 - protein, 13 aa, Artificial Sequence
  Synthetically generated peptide
CEFCKNGACGACY

SEQ ID NO: 5982 - protein, 13 aa, Artificial Sequence
  Synthetically generated peptide
CEFCKNGTCTGCY

SEQ ID NO: 5983 - protein, 13 aa, Artificial Sequence
  Synthetically generated peptide
CEFCKNGTCTACY

SEQ ID NO: 5984 - protein, 13 aa, Artificial Sequence
  Synthetically generated peptide
CEFCKNGTCVGCY

SEQ ID NO: 5985 - protein, 13 aa, Artificial Sequence
  Synthetically generated peptide
CEFCKNGTCVACY

SEQ ID NO: 5986 - protein, 13 aa, Artificial Sequence
  Synthetically generated peptide
CEFCKNGTCGGCY

SEQ ID NO: 5987 - protein, 13 aa, Artificial Sequence
  Synthetically generated peptide
CEFCKNGTCGACY

SEQ ID NO: 5988 - protein, 13 aa, Artificial Sequence
  Synthetically generated peptide
CEFCMNPACTGCY

SEQ ID NO: 5989 - protein, 13 aa, Artificial Sequence
  Synthetically generated peptide
CEFCMNPACTACY

SEQ ID NO: 5990 - protein, 13 aa, Artificial Sequence
  Synthetically generated peptide
CEFCMNPACVGCY

SEQ ID NO: 5991 - protein, 13 aa, Artificial Sequence
  Synthetically generated peptide
CEFCMNPACVACY

SEQ ID NO: 5992 - protein, 13 aa, Artificial Sequence
  Synthetically generated peptide
CEFCMNPACGGCY

SEQ ID NO: 5993 - protein, 13 aa, Artificial Sequence
  Synthetically generated peptide
CEFCMNPACGACY

SEQ ID NO: 5994 - protein, 13 aa, Artificial Sequence
  Synthetically generated peptide
CEFCMNPTCTGCY

SEQ ID NO: 5995 - protein, 13 aa, Artificial Sequence
  Synthetically generated peptide
CEFCMNPTCTACY

SEQ ID NO: 5996 - protein, 13 aa, Artificial Sequence
  Synthetically generated peptide
CEFCMNPTCVGCY

SEQ ID NO: 5997 - protein, 13 aa, Artificial Sequence
  Synthetically generated peptide
CEFCMNPTCVACY

SEQ ID NO: 5998 - protein, 13 aa, Artificial Sequence
  Synthetically generated peptide
CEFCMNPTCGGCY

SEQ ID NO: 5999 - protein, 13 aa, Artificial Sequence
  Synthetically generated peptide
CEFCMNPTCGACY

SEQ ID NO: 6000 - protein, 13 aa, Artificial Sequence
  Synthetically generated peptide
CEFCMNGACTGCY

SEQ ID NO: 6001 - protein, 13 aa, Artificial Sequence
  Synthetically generated peptide
CEFCMNGACTACY

SEQ ID NO: 6002 - protein, 13 aa, Artificial Sequence
  Synthetically generated peptide
CEFCMNGACVGCY

SEQ ID NO: 6003 - protein, 13 aa, Artificial Sequence
  Synthetically generated peptide
CEFCMNGACVACY

SEQ ID NO: 6004 - protein, 13 aa, Artificial Sequence
  Synthetically generated peptide
CEFCMNGACGGCY

SEQ ID NO: 6005 - protein, 13 aa, Artificial Sequence
  Synthetically generated peptide
CEFCMNGACGACY

SEQ ID NO: 6006 - protein, 13 aa, Artificial Sequence
  Synthetically generated peptide
CEFCMNGTCTGCY

SEQ ID NO: 6007 - protein, 13 aa, Artificial Sequence
  Synthetically generated peptide
CEFCMNGTCTACY

SEQ ID NO: 6008 - protein, 13 aa, Artificial Sequence
  Synthetically generated peptide
CEFCMNGTCVGCY

SEQ ID NO: 6009 - protein, 13 aa, Artificial Sequence
  Synthetically generated peptide
CEFCMNGTCVACY

SEQ ID NO: 6010 - protein, 13 aa, Artificial Sequence
  Synthetically generated peptide
CEFCMNGTCGGCY

SEQ ID NO: 6011 - protein, 13 aa, Artificial Sequence
  Synthetically generated peptide
CEFCMNGTCGACY

SEQ ID NO: 6012 - protein, 13 aa, Artificial Sequence
  Synthetically generated peptide
CEFCFNPACTGCY

SEQ ID NO: 6013 - protein, 13 aa, Artificial Sequence
  Synthetically generated peptide
CEFCFNPACTACY

SEQ ID NO: 6014 - protein, 13 aa, Artificial Sequence
  Synthetically generated peptide
CEFCFNPACVGCY

SEQ ID NO: 6015 - protein, 13 aa, Artificial Sequence
  Synthetically generated peptide
CEFCFNPACVACY

SEQ ID NO: 6016 - protein, 13 aa, Artificial Sequence
  Synthetically generated peptide
CEFCFNPACGGCY

SEQ ID NO: 6017 - protein, 13 aa, Artificial Sequence
  Synthetically generated peptide
CEFCFNPACGACY

SEQ ID NO: 6018 - protein, 13 aa, Artificial Sequence
  Synthetically generated peptide
CEFCFNPTCTGCY

SEQ ID NO: 6019 - protein, 13 aa, Artificial Sequence
  Synthetically generated peptide
CEFCFNPTCTACY

SEQ ID NO: 6020 - protein, 13 aa, Artificial Sequence
  Synthetically generated peptide
CEFCFNPTCVGCY

SEQ ID NO: 6021 - protein, 13 aa, Artificial Sequence
  Synthetically generated peptide
CEFCFNPTCVACY

SEQ ID NO: 6022 - protein, 13 aa, Artificial Sequence
  Synthetically generated peptide
CEFCFNPTCGGCY

SEQ ID NO: 6023 - protein, 13 aa, Artificial Sequence
  Synthetically generated peptide
CEFCFNPTCGACY

SEQ ID NO: 6024 - protein, 13 aa, Artificial Sequence
  Synthetically generated peptide
CEFCFNGACTGCY

SEQ ID NO: 6025 - protein, 13 aa, Artificial Sequence
  Synthetically generated peptide
CEFCFNGACTACY

SEQ ID NO: 6026 - protein, 13 aa, Artificial Sequence
  Synthetically generated peptide
CEFCFNGACVGCY

SEQ ID NO: 6027 - protein, 13 aa, Artificial Sequence
  Synthetically generated peptide
CEFCFNGACVACY

SEQ ID NO: 6028 - protein, 13 aa, Artificial Sequence
  Synthetically generated peptide
CEFCFNGACGGCY

SEQ ID NO: 6029 - protein, 13 aa, Artificial Sequence
  Synthetically generated peptide
CEFCFNGACGACY

SEQ ID NO: 6030 - protein, 13 aa, Artificial Sequence
  Synthetically generated peptide
CEFCFNGTCTGCY

SEQ ID NO: 6031 - protein, 13 aa, Artificial Sequence
  Synthetically generated peptide
CEFCFNGTCTACY

SEQ ID NO: 6032 - protein, 13 aa, Artificial Sequence
  Synthetically generated peptide
CEFCFNGTCVGCY

SEQ ID NO: 6033 - protein, 13 aa, Artificial Sequence
  Synthetically generated peptide
CEFCFNGTCVACY

SEQ ID NO: 6034 - protein, 13 aa, Artificial Sequence
  Synthetically generated peptide
CEFCFNGTCGGCY

SEQ ID NO: 6035 - protein, 13 aa, Artificial Sequence
  Synthetically generated peptide
CEFCFNGTCGACY

SEQ ID NO: 6036 - protein, 13 aa, Artificial Sequence
  Synthetically generated peptide
CEFCPNPACTGCY

SEQ ID NO: 6037 - protein, 13 aa, Artificial Sequence
  Synthetically generated peptide
CEFCPNPACTACY

SEQ ID NO: 6038 - protein, 13 aa, Artificial Sequence
  Synthetically generated peptide
CEFCPNPACVGCY

SEQ ID NO: 6039 - protein, 13 aa, Artificial Sequence
  Synthetically generated peptide
CEFCPNPACVACY

SEQ ID NO: 6040 - protein, 13 aa, Artificial Sequence
  Synthetically generated peptide
CEFCPNPACGGCY

SEQ ID NO: 6041 - protein, 13 aa, Artificial Sequence
  Synthetically generated peptide
CEFCPNPACGACY

SEQ ID NO: 6042 - protein, 13 aa, Artificial Sequence
  Synthetically generated peptide
CEFCPNPTCTGCY

SEQ ID NO: 6043 - protein, 13 aa, Artificial Sequence
  Synthetically generated peptide
CEFCPNPTCTACY

SEQ ID NO: 6044 - protein, 13 aa, Artificial Sequence
  Synthetically generated peptide
CEFCPNPTCVGCY

SEQ ID NO: 6045 - protein, 13 aa, Artificial Sequence
  Synthetically generated peptide
CEFCPNPTCVACY

SEQ ID NO: 6046 - protein, 13 aa, Artificial Sequence
  Synthetically generated peptide
CEFCPNPTCGGCY

SEQ ID NO: 6047 - protein, 13 aa, Artificial Sequence
  Synthetically generated peptide
CEFCPNPTCGACY

SEQ ID NO: 6048 - protein, 13 aa, Artificial Sequence
  Synthetically generated peptide
CEFCPNGACTGCY

SEQ ID NO: 6049 - protein, 13 aa, Artificial Sequence
  Synthetically generated peptide
CEFCPNGACTACY

SEQ ID NO: 6050 - protein, 13 aa, Artificial Sequence
  Synthetically generated peptide
CEFCPNGACVGCY

SEQ ID NO: 6051 - protein, 13 aa, Artificial Sequence
  Synthetically generated peptide
CEFCPNGACVACY

SEQ ID NO: 6052 - protein, 13 aa, Artificial Sequence
  Synthetically generated peptide
CEFCPNGACGGCY

SEQ ID NO: 6053 - protein, 13 aa, Artificial Sequence
  Synthetically generated peptide
CEFCPNGACGACY

SEQ ID NO: 6054 - protein, 13 aa, Artificial Sequence
  Synthetically generated peptide
CEFCPNGTCTGCY

SEQ ID NO: 6055 - protein, 13 aa, Artificial Sequence
  Synthetically generated peptide
CEFCPNGTCTACY

SEQ ID NO: 6056 - protein, 13 aa, Artificial Sequence
  Synthetically generated peptide
CEFCPNGTCVGCY

SEQ ID NO: 6057 - protein, 13 aa, Artificial Sequence
  Synthetically generated peptide
CEFCPNGTCVACY

SEQ ID NO: 6058 - protein, 13 aa, Artificial Sequence
  Synthetically generated peptide
CEFCPNGTCGGCY

SEQ ID NO: 6059 - protein, 13 aa, Artificial Sequence
  Synthetically generated peptide
CEFCPNGTCGACY

SEQ ID NO: 6060 - protein, 13 aa, Artificial Sequence
  Synthetically generated peptide
CEFCSNPACTGCY

SEQ ID NO: 6061 - protein, 13 aa, Artificial Sequence
  Synthetically generated peptide
CEFCSNPACTACY

SEQ ID NO: 6062 - protein, 13 aa, Artificial Sequence
  Synthetically generated peptide
CEFCSNPACVGCY

SEQ ID NO: 6063 - protein, 13 aa, Artificial Sequence
  Synthetically generated peptide
CEFCSNPACVACY

SEQ ID NO: 6064 - protein, 13 aa, Artificial Sequence
  Synthetically generated peptide
CEFCSNPACGGCY

SEQ ID NO: 6065 - protein, 13 aa, Artificial Sequence
  Synthetically generated peptide
CEFCSNPACGACY

SEQ ID NO: 6066 - protein, 13 aa, Artificial Sequence
  Synthetically generated peptide
CEFCSNPTCTGCY

SEQ ID NO: 6067 - protein, 13 aa, Artificial Sequence
  Synthetically generated peptide
CEFCSNPTCTACY

SEQ ID NO: 6068 - protein, 13 aa, Artificial Sequence
  Synthetically generated peptide
CEFCSNPTCVGCY

SEQ ID NO: 6069 - protein, 13 aa, Artificial Sequence
  Synthetically generated peptide
CEFCSNPTCVACY

SEQ ID NO: 6070 - protein, 13 aa, Artificial Sequence
  Synthetically generated peptide
CEFCSNPTCGGCY

SEQ ID NO: 6071 - protein, 13 aa, Artificial Sequence
  Synthetically generated peptide
CEFCSNPTCGACY

SEQ ID NO: 6072 - protein, 13 aa, Artificial Sequence
  Synthetically generated peptide
CEFCSNGACTGCY

SEQ ID NO: 6073 - protein, 13 aa, Artificial Sequence
  Synthetically generated peptide
CEFCSNGACTACY

SEQ ID NO: 6074 - protein, 13 aa, Artificial Sequence
  Synthetically generated peptide
CEFCSNGACVGCY

SEQ ID NO: 6075 - protein, 13 aa, Artificial Sequence
  Synthetically generated peptide
CEFCSNGACVACY

SEQ ID NO: 6076 - protein, 13 aa, Artificial Sequence
  Synthetically generated peptide
CEFCSNGACGGCY

SEQ ID NO: 6077 - protein, 13 aa, Artificial Sequence
  Synthetically generated peptide
CEFCSNGACGACY

SEQ ID NO: 6078 - protein, 13 aa, Artificial Sequence
  Synthetically generated peptide
CEFCSNGTCTGCY

SEQ ID NO: 6079 - protein, 13 aa, Artificial Sequence
  Synthetically generated peptide
CEFCSNGTCTACY

SEQ ID NO: 6080 - protein, 13 aa, Artificial Sequence
  Synthetically generated peptide
CEFCSNGTCVGCY

SEQ ID NO: 6081 - protein, 13 aa, Artificial Sequence
  Synthetically generated peptide
CEFCSNGTCVACY

SEQ ID NO: 6082 - protein, 13 aa, Artificial Sequence
  Synthetically generated peptide
CEFCSNGTCGGCY

SEQ ID NO: 6083 - protein, 13 aa, Artificial Sequence
  Synthetically generated peptide
CEFCSNGTCGACY

SEQ ID NO: 6084 - protein, 13 aa, Artificial Sequence
  Synthetically generated peptide
CEFCTNPACTGCY

SEQ ID NO: 6085 - protein, 13 aa, Artificial Sequence
  Synthetically generated peptide
CEFCTNPACTACY

SEQ ID NO: 6086 - protein, 13 aa, Artificial Sequence
  Synthetically generated peptide
CEFCTNPACVGCY

SEQ ID NO: 6087 - protein, 13 aa, Artificial Sequence
  Synthetically generated peptide
CEFCTNPACVACY

SEQ ID NO: 6088 - protein, 13 aa, Artificial Sequence
  Synthetically generated peptide
CEFCTNPACGGCY

SEQ ID NO: 6089 - protein, 13 aa, Artificial Sequence
  Synthetically generated peptide
CEFCTNPACGACY

SEQ ID NO: 6090 - protein, 13 aa, Artificial Sequence
  Synthetically generated peptide
CEFCTNPTCTGCY

SEQ ID NO: 6091 - protein, 13 aa, Artificial Sequence
  Synthetically generated peptide
CEFCTNPTCTACY

SEQ ID NO: 6092 - protein, 13 aa, Artificial Sequence
  Synthetically generated peptide
CEFCTNPTCVGCY

SEQ ID NO: 6093 - protein, 13 aa, Artificial Sequence
  Synthetically generated peptide
CEFCTNPTCVACY

SEQ ID NO: 6094 - protein, 13 aa, Artificial Sequence
  Synthetically generated peptide
CEFCTNPTCGGCY

SEQ ID NO: 6095 - protein, 13 aa, Artificial Sequence
  Synthetically generated peptide
CEFCTNPTCGACY

SEQ ID NO: 6096 - protein, 13 aa, Artificial Sequence
  Synthetically generated peptide
CEFCTNGACTGCY

SEQ ID NO: 6097 - protein, 13 aa, Artificial Sequence
  Synthetically generated peptide
CEFCTNGACTACY

SEQ ID NO: 6098 - protein, 13 aa, Artificial Sequence
  Synthetically generated peptide
CEFCTNGACVGCY

SEQ ID NO: 6099 - protein, 13 aa, Artificial Sequence
  Synthetically generated peptide
CEFCTNGACVACY

SEQ ID NO: 6100 - protein, 13 aa, Artificial Sequence
  Synthetically generated peptide
CEFCTNGACGGCY

SEQ ID NO: 6101 - protein, 13 aa, Artificial Sequence
  Synthetically generated peptide
CEFCTNGACGACY

SEQ ID NO: 6102 - protein, 13 aa, Artificial Sequence
  Synthetically generated peptide
CEFCTNGTCTGCY

SEQ ID NO: 6103 - protein, 13 aa, Artificial Sequence
  Synthetically generated peptide
CEFCTNGTCTACY

SEQ ID NO: 6104 - protein, 13 aa, Artificial Sequence
  Synthetically generated peptide
CEFCTNGTCVGCY

SEQ ID NO: 6105 - protein, 13 aa, Artificial Sequence
  Synthetically generated peptide
CEFCTNGTCVACY

SEQ ID NO: 6106 - protein, 13 aa, Artificial Sequence
  Synthetically generated peptide
CEFCTNGTCGGCY

SEQ ID NO: 6107 - protein, 13 aa, Artificial Sequence
  Synthetically generated peptide
CEFCTNGTCGACY

SEQ ID NO: 6108 - protein, 13 aa, Artificial Sequence
  Synthetically generated peptide
CEFCWNPACTGCY

SEQ ID NO: 6109 - protein, 13 aa, Artificial Sequence
  Synthetically generated peptide
CEFCWNPACTACY

SEQ ID NO: 6110 - protein, 13 aa, Artificial Sequence
  Synthetically generated peptide
CEFCWNPACVGCY

SEQ ID NO: 6111 - protein, 13 aa, Artificial Sequence
  Synthetically generated peptide
CEFCWNPACVACY

SEQ ID NO: 6112 - protein, 13 aa, Artificial Sequence
  Synthetically generated peptide
CEFCWNPACGGCY

SEQ ID NO: 6113 - protein, 13 aa, Artificial Sequence
  Synthetically generated peptide
CEFCWNPACGACY

SEQ ID NO: 6114 - protein, 13 aa, Artificial Sequence
  Synthetically generated peptide
CEFCWNPTCTGCY

SEQ ID NO: 6115 - protein, 13 aa, Artificial Sequence
  Synthetically generated peptide
CEFCWNPTCTACY

SEQ ID NO: 6116 - protein, 13 aa, Artificial Sequence
  Synthetically generated peptide
CEFCWNPTCVGCY

SEQ ID NO: 6117 - protein, 13 aa, Artificial Sequence
  Synthetically generated peptide
CEFCWNPTCVACY

SEQ ID NO: 6118 - protein, 13 aa, Artificial Sequence
  Synthetically generated peptide
CEFCWNPTCGGCY

SEQ ID NO: 6119 - protein, 13 aa, Artificial Sequence
  Synthetically generated peptide
CEFCWNPTCGACY

SEQ ID NO: 6120 - protein, 13 aa, Artificial Sequence
  Synthetically generated peptide
CEFCWNGACTGCY

SEQ ID NO: 6121 - protein, 13 aa, Artificial Sequence
  Synthetically generated peptide
CEFCWNGACTACY

SEQ ID NO: 6122 - protein, 13 aa, Artificial Sequence
  Synthetically generated peptide
CEFCWNGACVGCY

SEQ ID NO: 6123 - protein, 13 aa, Artificial Sequence
  Synthetically generated peptide
CEFCWNGACVACY

SEQ ID NO: 6124 - protein, 13 aa, Artificial Sequence
  Synthetically generated peptide
CEFCWNGACGGCY

SEQ ID NO: 6125 - protein, 13 aa, Artificial Sequence
  Synthetically generated peptide
CEFCWNGACGACY

SEQ ID NO: 6126 - protein, 13 aa, Artificial Sequence
  Synthetically generated peptide
CEFCWNGTCTGCY

SEQ ID NO: 6127 - protein, 13 aa, Artificial Sequence
  Synthetically generated peptide
CEFCWNGTCTACY

SEQ ID NO: 6128 - protein, 13 aa, Artificial Sequence
  Synthetically generated peptide
CEFCWNGTCVGCY

SEQ ID NO: 6129 - protein, 13 aa, Artificial Sequence
  Synthetically generated peptide
CEFCWNGTCVACY

SEQ ID NO: 6130 - protein, 13 aa, Artificial Sequence
  Synthetically generated peptide
CEFCWNGTCGGCY

SEQ ID NO: 6131 - protein, 13 aa, Artificial Sequence
  Synthetically generated peptide
CEFCWNGTCGACY

SEQ ID NO: 6132 - protein, 13 aa, Artificial Sequence
  Synthetically generated peptide
CEFCYNPACTGCY

SEQ ID NO: 6133 - protein, 13 aa, Artificial Sequence
  Synthetically generated peptide
CEFCYNPACTACY

SEQ ID NO: 6134 - protein, 13 aa, Artificial Sequence
  Synthetically generated peptide
CEFCYNPACVGCY

SEQ ID NO: 6135 - protein, 13 aa, Artificial Sequence
  Synthetically generated peptide
CEFCYNPACVACY

SEQ ID NO: 6136 - protein, 13 aa, Artificial Sequence
  Synthetically generated peptide
CEFCYNPACGGCY

SEQ ID NO: 6137 - protein, 13 aa, Artificial Sequence
  Synthetically generated peptide
CEFCYNPACGACY

SEQ ID NO: 6138 - protein, 13 aa, Artificial Sequence
  Synthetically generated peptide
CEFCYNPTCTGCY

SEQ ID NO: 6139 - protein, 13 aa, Artificial Sequence
  Synthetically generated peptide
CEFCYNPTCTACY

SEQ ID NO: 6140 - protein, 13 aa, Artificial Sequence
  Synthetically generated peptide
CEFCYNPTCVGCY

SEQ ID NO: 6141 - protein, 13 aa, Artificial Sequence
  Synthetically generated peptide
CEFCYNPTCVACY

SEQ ID NO: 6142 - protein, 13 aa, Artificial Sequence
  Synthetically generated peptide
CEFCYNPTCGGCY

SEQ ID NO: 6143 - protein, 13 aa, Artificial Sequence
  Synthetically generated peptide
CEFCYNPTCGACY

SEQ ID NO: 6144 - protein, 13 aa, Artificial Sequence
  Synthetically generated peptide
CEFCYNGACTGCY

SEQ ID NO: 6145 - protein, 13 aa, Artificial Sequence
  Synthetically generated peptide
CEFCYNGACTACY

SEQ ID NO: 6146 - protein, 13 aa, Artificial Sequence
  Synthetically generated peptide
CEFCYNGACVGCY

SEQ ID NO: 6147 - protein, 13 aa, Artificial Sequence
  Synthetically generated peptide
CEFCYNGACVACY

SEQ ID NO: 6148 - protein, 13 aa, Artificial Sequence
  Synthetically generated peptide
CEFCYNGACGGCY

SEQ ID NO: 6149 - protein, 13 aa, Artificial Sequence
  Synthetically generated peptide
CEFCYNGACGACY

SEQ ID NO: 6150 - protein, 13 aa, Artificial Sequence
  Synthetically generated peptide
CEFCYNGTCTGCY

SEQ ID NO: 6151 - protein, 13 aa, Artificial Sequence
  Synthetically generated peptide
CEFCYNGTCTACY

SEQ ID NO: 6152 - protein, 13 aa, Artificial Sequence
  Synthetically generated peptide
CEFCYNGTCVGCY

SEQ ID NO: 6153 - protein, 13 aa, Artificial Sequence
  Synthetically generated peptide
CEFCYNGTCVACY

SEQ ID NO: 6154 - protein, 13 aa, Artificial Sequence
  Synthetically generated peptide
CEFCYNGTCGGCY

SEQ ID NO: 6155 - protein, 13 aa, Artificial Sequence
  Synthetically generated peptide
CEFCYNGTCGACY

SEQ ID NO: 6156 - protein, 13 aa, Artificial Sequence
  Synthetically generated peptide
CEFCVNPACTGCY

SEQ ID NO: 6157 - protein, 13 aa, Artificial Sequence
  Synthetically generated peptide
CEFCVNPACTACY

SEQ ID NO: 6158 - protein, 13 aa, Artificial Sequence
  Synthetically generated peptide
CEFCVNPACVGCY

SEQ ID NO: 6159 - protein, 13 aa, Artificial Sequence
  Synthetically generated peptide
CEFCVNPACVACY

SEQ ID NO: 6160 - protein, 13 aa, Artificial Sequence
  Synthetically generated peptide
CEFCVNPACGGCY

SEQ ID NO: 6161 - protein, 13 aa, Artificial Sequence
  Synthetically generated peptide
CEFCVNPACGACY

SEQ ID NO: 6162 - protein, 13 aa, Artificial Sequence
  Synthetically generated peptide
CEFCVNPTCTGCY

SEQ ID NO: 6163 - protein, 13 aa, Artificial Sequence
  Synthetically generated peptide
CEFCVNPTCTACY

SEQ ID NO: 6164 - protein, 13 aa, Artificial Sequence
  Synthetically generated peptide
CEFCVNPTCVGCY

SEQ ID NO: 6165 - protein, 13 aa, Artificial Sequence
  Synthetically generated peptide
CEFCVNPTCVACY

SEQ ID NO: 6166 - protein, 13 aa, Artificial Sequence
  Synthetically generated peptide
CEFCVNPTCGGCY

SEQ ID NO: 6167 - protein, 13 aa, Artificial Sequence
  Synthetically generated peptide
CEFCVNPTCGACY

SEQ ID NO: 6168 - protein, 13 aa, Artificial Sequence
  Synthetically generated peptide
CEFCVNGACTGCY

SEQ ID NO: 6169 - protein, 13 aa, Artificial Sequence
  Synthetically generated peptide
CEFCVNGACTACY

SEQ ID NO: 6170 - protein, 13 aa, Artificial Sequence
  Synthetically generated peptide
CEFCVNGACVGCY

SEQ ID NO: 6171 - protein, 13 aa, Artificial Sequence
  Synthetically generated peptide
CEFCVNGACVACY

SEQ ID NO: 6172 - protein, 13 aa, Artificial Sequence
  Synthetically generated peptide
CEFCVNGACGGCY

SEQ ID NO: 6173 - protein, 13 aa, Artificial Sequence
  Synthetically generated peptide
CEFCVNGACGACY

SEQ ID NO: 6174 - protein, 13 aa, Artificial Sequence
  Synthetically generated peptide
CEFCVNGTCTGCY

SEQ ID NO: 6175 - protein, 13 aa, Artificial Sequence
  Synthetically generated peptide
CEFCVNGTCTACY

SEQ ID NO: 6176 - protein, 13 aa, Artificial Sequence
  Synthetically generated peptide
CEFCVNGTCVGCY

SEQ ID NO: 6177 - protein, 13 aa, Artificial Sequence
  Synthetically generated peptide
CEFCVNGTCVACY

SEQ ID NO: 6178 - protein, 13 aa, Artificial Sequence
  Synthetically generated peptide
CEFCVNGTCGGCY

SEQ ID NO: 6179 - protein, 13 aa, Artificial Sequence
  Synthetically generated peptide
CEFCVNGTCGACY

SEQ ID NO: 6180 - protein, 12 aa, Artificial Sequence
  Synthetically generated peptide
CEFCNPACTGCY

SEQ ID NO: 6181 - protein, 12 aa, Artificial Sequence
  Synthetically generated peptide
CEFCNPACTACY

SEQ ID NO: 6182 - protein, 12 aa, Artificial Sequence
  Synthetically generated peptide
CEFCNPACVGCY

SEQ ID NO: 6183 - protein, 12 aa, Artificial Sequence
  Synthetically generated peptide
CEFCNPACVACY

SEQ ID NO: 6184 - protein, 12 aa, Artificial Sequence
  Synthetically generated peptide
CEFCNPACGGCY

SEQ ID NO: 6185 - protein, 12 aa, Artificial Sequence
  Synthetically generated peptide
CEFCNPACGACY

SEQ ID NO: 6186 - protein, 12 aa, Artificial Sequence
  Synthetically generated peptide
CEFCNPTCTGCY

SEQ ID NO: 6187 - protein, 12 aa, Artificial Sequence
  Synthetically generated peptide
CEFCNPTCTACY

SEQ ID NO: 6188 - protein, 12 aa, Artificial Sequence
  Synthetically generated peptide
CEFCNPTCVGCY

SEQ ID NO: 6189 - protein, 12 aa, Artificial Sequence
  Synthetically generated peptide
CEFCNPTCVACY

SEQ ID NO: 6190 - protein, 12 aa, Artificial Sequence
  Synthetically generated peptide
CEFCNPTCGGCY

SEQ ID NO: 6191 - protein, 12 aa, Artificial Sequence
  Synthetically generated peptide
CEFCNPTCGACY

SEQ ID NO: 6192 - protein, 12 aa, Artificial Sequence
  Synthetically generated peptide
CEFCNGACTGCY

SEQ ID NO: 6193 - protein, 12 aa, Artificial Sequence
  Synthetically generated peptide
CEFCNGACTACY

SEQ ID NO: 6194 - protein, 12 aa, Artificial Sequence
  Synthetically generated peptide
CEFCNGACVGCY

SEQ ID NO: 6195 - protein, 12 aa, Artificial Sequence
  Synthetically generated peptide
CEFCNGACVACY

SEQ ID NO: 6196 - protein, 12 aa, Artificial Sequence
  Synthetically generated peptide
CEFCNGACGGCY

SEQ ID NO: 6197 - protein, 12 aa, Artificial Sequence
  Synthetically generated peptide
CEFCNGACGACY

SEQ ID NO: 6198 - protein, 12 aa, Artificial Sequence
  Synthetically generated peptide
CEFCNGTCTGCY

SEQ ID NO: 6199 - protein, 12 aa, Artificial Sequence
  Synthetically generated peptide
CEFCNGTCTACY

SEQ ID NO: 6200 - protein, 12 aa, Artificial Sequence
  Synthetically generated peptide
CEFCNGTCVGCY

SEQ ID NO: 6201 - protein, 12 aa, Artificial Sequence
  Synthetically generated peptide
CEFCNGTCVACY

SEQ ID NO: 6202 - protein, 12 aa, Artificial Sequence
  Synthetically generated peptide
CEFCNGTCGGCY

SEQ ID NO: 6203 - protein, 12 aa, Artificial Sequence
  Synthetically generated peptide
CEFCNGTCGACY

SEQ ID NO: 6204 - protein, 13 aa, Artificial Sequence
  Synthetically generated peptide
CELCANPACTGCY

SEQ ID NO: 6205 - protein, 13 aa, Artificial Sequence
  Synthetically generated peptide
CELCANPACTACY

SEQ ID NO: 6206 - protein, 13 aa, Artificial Sequence
  Synthetically generated peptide
CELCANPACVGCY

SEQ ID NO: 6207 - protein, 13 aa, Artificial Sequence
  Synthetically generated peptide
CELCANPACVACY

SEQ ID NO: 6208 - protein, 13 aa, Artificial Sequence
  Synthetically generated peptide
CELCANPACGGCY

SEQ ID NO: 6209 - protein, 13 aa, Artificial Sequence
  Synthetically generated peptide
CELCANPACGACY

SEQ ID NO: 6210 - protein, 13 aa, Artificial Sequence
  Synthetically generated peptide
CELCANPTCTGCY

SEQ ID NO: 6211 - protein, 13 aa, Artificial Sequence
  Synthetically generated peptide
CELCANPTCTACY

SEQ ID NO: 6212 - protein, 13 aa, Artificial Sequence
  Synthetically generated peptide
CELCANPTCVGCY

SEQ ID NO: 6213 - protein, 13 aa, Artificial Sequence
  Synthetically generated peptide
CELCANPTCVACY

SEQ ID NO: 6214 - protein, 13 aa, Artificial Sequence
  Synthetically generated peptide
CELCANPTCGGCY

SEQ ID NO: 6215 - protein, 13 aa, Artificial Sequence
  Synthetically generated peptide
CELCANPTCGACY

SEQ ID NO: 6216 - protein, 13 aa, Artificial Sequence
  Synthetically generated peptide
CELCANGACTGCY

SEQ ID NO: 6217 - protein, 13 aa, Artificial Sequence
  Synthetically generated peptide
CELCANGACTACY

SEQ ID NO: 6218 - protein, 13 aa, Artificial Sequence
  Synthetically generated peptide
CELCANGACVGCY

SEQ ID NO: 6219 - protein, 13 aa, Artificial Sequence
  Synthetically generated peptide
CELCANGACVACY

SEQ ID NO: 6220 - protein, 13 aa, Artificial Sequence
  Synthetically generated peptide
CELCANGACGGCY

SEQ ID NO: 6221 - protein, 13 aa, Artificial Sequence
  Synthetically generated peptide
CELCANGACGACY

SEQ ID NO: 6222 - protein, 13 aa, Artificial Sequence
  Synthetically generated peptide
CELCANGTCTGCY

SEQ ID NO: 6223 - protein, 13 aa, Artificial Sequence
  Synthetically generated peptide
CELCANGTCTACY

SEQ ID NO: 6224 - protein, 13 aa, Artificial Sequence
  Synthetically generated peptide
CELCANGTCVGCY

SEQ ID NO: 6225 - protein, 13 aa, Artificial Sequence
  Synthetically generated peptide
CELCANGTCVACY

SEQ ID NO: 6226 - protein, 13 aa, Artificial Sequence
  Synthetically generated peptide
CELCANGTCGGCY

SEQ ID NO: 6227 - protein, 13 aa, Artificial Sequence
  Synthetically generated peptide
CELCANGTCGACY

SEQ ID NO: 6228 - protein, 13 aa, Artificial Sequence
  Synthetically generated peptide
CELCRNPACTGCY

SEQ ID NO: 6229 - protein, 13 aa, Artificial Sequence
  Synthetically generated peptide
CELCRNPACTACY

SEQ ID NO: 6230 - protein, 13 aa, Artificial Sequence
  Synthetically generated peptide
CELCRNPACVGCY

SEQ ID NO: 6231 - protein, 13 aa, Artificial Sequence
  Synthetically generated peptide
CELCRNPACVACY

SEQ ID NO: 6232 - protein, 13 aa, Artificial Sequence
  Synthetically generated peptide
CELCRNPACGGCY

SEQ ID NO: 6233 - protein, 13 aa, Artificial Sequence
  Synthetically generated peptide
CELCRNPACGACY

SEQ ID NO: 6234 - protein, 13 aa, Artificial Sequence
  Synthetically generated peptide
CELCRNPTCTGCY

SEQ ID NO: 6235 - protein, 13 aa, Artificial Sequence
  Synthetically generated peptide
CELCRNPTCTACY

SEQ ID NO: 6236 - protein, 13 aa, Artificial Sequence
  Synthetically generated peptide
CELCRNPTCVGCY

SEQ ID NO: 6237 - protein, 13 aa, Artificial Sequence
  Synthetically generated peptide
CELCRNPTCVACY

SEQ ID NO: 6238 - protein, 13 aa, Artificial Sequence
  Synthetically generated peptide
CELCRNPTCGGCY

SEQ ID NO: 6239 - protein, 13 aa, Artificial Sequence
  Synthetically generated peptide
CELCRNPTCGACY

SEQ ID NO: 6240 - protein, 13 aa, Artificial Sequence
  Synthetically generated peptide
CELCRNGACTGCY

SEQ ID NO: 6241 - protein, 13 aa, Artificial Sequence
  Synthetically generated peptide
CELCRNGACTACY

SEQ ID NO: 6242 - protein, 13 aa, Artificial Sequence
  Synthetically generated peptide
CELCRNGACVGCY

SEQ ID NO: 6243 - protein, 13 aa, Artificial Sequence
  Synthetically generated peptide
CELCRNGACVACY

SEQ ID NO: 6244 - protein, 13 aa, Artificial Sequence
  Synthetically generated peptide
CELCRNGACGGCY

SEQ ID NO: 6245 - protein, 13 aa, Artificial Sequence
  Synthetically generated peptide
CELCRNGACGACY

SEQ ID NO: 6246 - protein, 13 aa, Artificial Sequence
  Synthetically generated peptide
CELCRNGTCTGCY

SEQ ID NO: 6247 - protein, 13 aa, Artificial Sequence
  Synthetically generated peptide
CELCRNGTCTACY

SEQ ID NO: 6248 - protein, 13 aa, Artificial Sequence
  Synthetically generated peptide
CELCRNGTCVGCY

SEQ ID NO: 6249 - protein, 13 aa, Artificial Sequence
  Synthetically generated peptide
CELCRNGTCVACY

SEQ ID NO: 6250 - protein, 13 aa, Artificial Sequence
  Synthetically generated peptide
CELCRNGTCGGCY

SEQ ID NO: 6251 - protein, 13 aa, Artificial Sequence
  Synthetically generated peptide
CELCRNGTCGACY

SEQ ID NO: 6252 - protein, 13 aa, Artificial Sequence
  Synthetically generated peptide
CELCNNPACTGCY

SEQ ID NO: 6253 - protein, 13 aa, Artificial Sequence
  Synthetically generated peptide
CELCNNPACTACY

SEQ ID NO: 6254 - protein, 13 aa, Artificial Sequence
  Synthetically generated peptide
CELCNNPACVGCY

SEQ ID NO: 6255 - protein, 13 aa, Artificial Sequence
  Synthetically generated peptide
CELCNNPACVACY

SEQ ID NO: 6256 - protein, 13 aa, Artificial Sequence
  Synthetically generated peptide
CELCNNPACGGCY

SEQ ID NO: 6257 - protein, 13 aa, Artificial Sequence
  Synthetically generated peptide
CELCNNPACGACY

SEQ ID NO: 6258 - protein, 13 aa, Artificial Sequence
  Synthetically generated peptide
CELCNNPTCTGCY

SEQ ID NO: 6259 - protein, 13 aa, Artificial Sequence
  Synthetically generated peptide
CELCNNPTCTACY

SEQ ID NO: 6260 - protein, 13 aa, Artificial Sequence
  Synthetically generated peptide
CELCNNPTCVGCY

SEQ ID NO: 6261 - protein, 13 aa, Artificial Sequence
  Synthetically generated peptide
CELCNNPTCVACY

SEQ ID NO: 6262 - protein, 13 aa, Artificial Sequence
  Synthetically generated peptide
CELCNNPTCGGCY

SEQ ID NO: 6263 - protein, 13 aa, Artificial Sequence
  Synthetically generated peptide
CELCNNPTCGACY

SEQ ID NO: 6264 - protein, 13 aa, Artificial Sequence
  Synthetically generated peptide
CELCNNGACTGCY

SEQ ID NO: 6265 - protein, 13 aa, Artificial Sequence
  Synthetically generated peptide
CELCNNGACTACY

SEQ ID NO: 6266 - protein, 13 aa, Artificial Sequence
  Synthetically generated peptide
CELCNNGACVGCY

SEQ ID NO: 6267 - protein, 13 aa, Artificial Sequence
  Synthetically generated peptide
CELCNNGACVACY

SEQ ID NO: 6268 - protein, 13 aa, Artificial Sequence
  Synthetically generated peptide
CELCNNGACGGCY

SEQ ID NO: 6269 - protein, 13 aa, Artificial Sequence
  Synthetically generated peptide
CELCNNGACGACY

SEQ ID NO: 6270 - protein, 13 aa, Artificial Sequence
  Synthetically generated peptide
CELCNNGTCTGCY

SEQ ID NO: 6271 - protein, 13 aa, Artificial Sequence
  Synthetically generated peptide
CELCNNGTCTACY

SEQ ID NO: 6272 - protein, 13 aa, Artificial Sequence
  Synthetically generated peptide
CELCNNGTCVGCY

SEQ ID NO: 6273 - protein, 13 aa, Artificial Sequence
  Synthetically generated peptide
CELCNNGTCVACY

SEQ ID NO: 6274 - protein, 13 aa, Artificial Sequence
  Synthetically generated peptide
CELCNNGTCGGCY

SEQ ID NO: 6275 - protein, 13 aa, Artificial Sequence
  Synthetically generated peptide
CELCNNGTCGACY

SEQ ID NO: 6276 - protein, 13 aa, Artificial Sequence
  Synthetically generated peptide
CELCDNPACTGCY

SEQ ID NO: 6277 - protein, 13 aa, Artificial Sequence
  Synthetically generated peptide
CELCDNPACTACY

SEQ ID NO: 6278 - protein, 13 aa, Artificial Sequence
  Synthetically generated peptide
CELCDNPACVGCY

SEQ ID NO: 6279 - protein, 13 aa, Artificial Sequence
  Synthetically generated peptide
CELCDNPACVACY

SEQ ID NO: 6280 - protein, 13 aa, Artificial Sequence
  Synthetically generated peptide
CELCDNPACGGCY

SEQ ID NO: 6281 - protein, 13 aa, Artificial Sequence
  Synthetically generated peptide
CELCDNPACGACY

SEQ ID NO: 6282 - protein, 13 aa, Artificial Sequence
  Synthetically generated peptide
CELCDNPTCTGCY

SEQ ID NO: 6283 - protein, 13 aa, Artificial Sequence
  Synthetically generated peptide
CELCDNPTCTACY

SEQ ID NO: 6284 - protein, 13 aa, Artificial Sequence
  Synthetically generated peptide
CELCDNPTCVGCY

SEQ ID NO: 6285 - protein, 13 aa, Artificial Sequence
  Synthetically generated peptide
CELCDNPTCVACY

SEQ ID NO: 6286 - protein, 13 aa, Artificial Sequence
  Synthetically generated peptide
CELCDNPTCGGCY

SEQ ID NO: 6287 - protein, 13 aa, Artificial Sequence
  Synthetically generated peptide
CELCDNPTCGACY

SEQ ID NO: 6288 - protein, 13 aa, Artificial Sequence
  Synthetically generated peptide
CELCDNGACTGCY

SEQ ID NO: 6289 - protein, 13 aa, Artificial Sequence
  Synthetically generated peptide
CELCDNGACTACY

SEQ ID NO: 6290 - protein, 13 aa, Artificial Sequence
  Synthetically generated peptide
CELCDNGACVGCY

SEQ ID NO: 6291 - protein, 13 aa, Artificial Sequence
  Synthetically generated peptide
CELCDNGACVACY

SEQ ID NO: 6292 - protein, 13 aa, Artificial Sequence
  Synthetically generated peptide
CELCDNGACGGCY

SEQ ID NO: 6293 - protein, 13 aa, Artificial Sequence
  Synthetically generated peptide
CELCDNGACGACY

SEQ ID NO: 6294 - protein, 13 aa, Artificial Sequence
  Synthetically generated peptide
CELCDNGTCTGCY

SEQ ID NO: 6295 - protein, 13 aa, Artificial Sequence
  Synthetically generated peptide
CELCDNGTCTACY

SEQ ID NO: 6296 - protein, 13 aa, Artificial Sequence
  Synthetically generated peptide
CELCDNGTCVGCY

SEQ ID NO: 6297 - protein, 13 aa, Artificial Sequence
  Synthetically generated peptide
CELCDNGTCVACY

SEQ ID NO: 6298 - protein, 13 aa, Artificial Sequence
  Synthetically generated peptide
CELCDNGTCGGCY

SEQ ID NO: 6299 - protein, 13 aa, Artificial Sequence
  Synthetically generated peptide
CELCDNGTCGACY

SEQ ID NO: 6300 - protein, 13 aa, Artificial Sequence
  Synthetically generated peptide
CELCQNPACTGCY

SEQ ID NO: 6301 - protein, 13 aa, Artificial Sequence
  Synthetically generated peptide
CELCQNPACTACY

SEQ ID NO: 6302 - protein, 13 aa, Artificial Sequence
  Synthetically generated peptide
CELCQNPACVGCY

SEQ ID NO: 6303 - protein, 13 aa, Artificial Sequence
  Synthetically generated peptide
CELCQNPACVACY

SEQ ID NO: 6304 - protein, 13 aa, Artificial Sequence
  Synthetically generated peptide
CELCQNPACGGCY

SEQ ID NO: 6305 - protein, 13 aa, Artificial Sequence
  Synthetically generated peptide
CELCQNPACGACY

SEQ ID NO: 6306 - protein, 13 aa, Artificial Sequence
  Synthetically generated peptide
CELCQNPTCTGCY

SEQ ID NO: 6307 - protein, 13 aa, Artificial Sequence
  Synthetically generated peptide
CELCQNPTCTACY

SEQ ID NO: 6308 - protein, 13 aa, Artificial Sequence
  Synthetically generated peptide
CELCQNPTCVGCY

SEQ ID NO: 6309 - protein, 13 aa, Artificial Sequence
  Synthetically generated peptide
CELCQNPTCVACY

SEQ ID NO: 6310 - protein, 13 aa, Artificial Sequence
  Synthetically generated peptide
CELCQNPTCGGCY

SEQ ID NO: 6311 - protein, 13 aa, Artificial Sequence
  Synthetically generated peptide
CELCQNPTCGACY

SEQ ID NO: 6312 - protein, 13 aa, Artificial Sequence
  Synthetically generated peptide
CELCQNGACTGCY

SEQ ID NO: 6313 - protein, 13 aa, Artificial Sequence
  Synthetically generated peptide
CELCQNGACTACY

SEQ ID NO: 6314 - protein, 13 aa, Artificial Sequence
  Synthetically generated peptide
CELCQNGACVGCY

SEQ ID NO: 6315 - protein, 13 aa, Artificial Sequence
  Synthetically generated peptide
CELCQNGACVACY

SEQ ID NO: 6316 - protein, 13 aa, Artificial Sequence
  Synthetically generated peptide
CELCQNGACGGCY

SEQ ID NO: 6317 - protein, 13 aa, Artificial Sequence
  Synthetically generated peptide
CELCQNGACGACY

SEQ ID NO: 6318 - protein, 13 aa, Artificial Sequence
  Synthetically generated peptide
CELCQNGTCTGCY

SEQ ID NO: 6319 - protein, 13 aa, Artificial Sequence
  Synthetically generated peptide
CELCQNGTCTACY

SEQ ID NO: 6320 - protein, 13 aa, Artificial Sequence
  Synthetically generated peptide
CELCQNGTCVGCY

SEQ ID NO: 6321 - protein, 13 aa, Artificial Sequence
  Synthetically generated peptide
CELCQNGTCVACY

SEQ ID NO: 6322 - protein, 13 aa, Artificial Sequence
  Synthetically generated peptide
CELCQNGTCGGCY

SEQ ID NO: 6323 - protein, 13 aa, Artificial Sequence
  Synthetically generated peptide
CELCQNGTCGACY

SEQ ID NO: 6324 - protein, 13 aa, Artificial Sequence
  Synthetically generated peptide
CELCENPACTGCY

SEQ ID NO: 6325 - protein, 13 aa, Artificial Sequence
  Synthetically generated peptide
CELCENPACTACY

SEQ ID NO: 6326 - protein, 13 aa, Artificial Sequence
  Synthetically generated peptide
CELCENPACVGCY

SEQ ID NO: 6327 - protein, 13 aa, Artificial Sequence
  Synthetically generated peptide
CELCENPACVACY

SEQ ID NO: 6328 - protein, 13 aa, Artificial Sequence
  Synthetically generated peptide
CELCENPACGGCY

SEQ ID NO: 6329 - protein, 13 aa, Artificial Sequence
  Synthetically generated peptide
CELCENPACGACY

SEQ ID NO: 6330 - protein, 13 aa, Artificial Sequence
  Synthetically generated peptide
CELCENPTCTGCY

SEQ ID NO: 6331 - protein, 13 aa, Artificial Sequence
  Synthetically generated peptide
CELCENPTCTACY

SEQ ID NO: 6332 - protein, 13 aa, Artificial Sequence
  Synthetically generated peptide
CELCENPTCVGCY

SEQ ID NO: 6333 - protein, 13 aa, Artificial Sequence
  Synthetically generated peptide
CELCENPTCVACY

SEQ ID NO: 6334 - protein, 13 aa, Artificial Sequence
  Synthetically generated peptide
CELCENPTCGGCY

SEQ ID NO: 6335 - protein, 13 aa, Artificial Sequence
  Synthetically generated peptide
CELCENPTCGACY

SEQ ID NO: 6336 - protein, 13 aa, Artificial Sequence
  Synthetically generated peptide
CELCENGACTGCY

SEQ ID NO: 6337 - protein, 13 aa, Artificial Sequence
  Synthetically generated peptide
CELCENGACTACY

SEQ ID NO: 6338 - protein, 13 aa, Artificial Sequence
  Synthetically generated peptide
CELCENGACVGCY

SEQ ID NO: 6339 - protein, 13 aa, Artificial Sequence
  Synthetically generated peptide
CELCENGACVACY

SEQ ID NO: 6340 - protein, 13 aa, Artificial Sequence
  Synthetically generated peptide
CELCENGACGGCY

SEQ ID NO: 6341 - protein, 13 aa, Artificial Sequence
  Synthetically generated peptide
CELCENGACGACY

SEQ ID NO: 6342 - protein, 13 aa, Artificial Sequence
  Synthetically generated peptide
CELCENGTCTGCY

SEQ ID NO: 6343 - protein, 13 aa, Artificial Sequence
  Synthetically generated peptide
CELCENGTCTACY

SEQ ID NO: 6344 - protein, 13 aa, Artificial Sequence
  Synthetically generated peptide
CELCENGTCVGCY

SEQ ID NO: 6345 - protein, 13 aa, Artificial Sequence
  Synthetically generated peptide
CELCENGTCVACY

SEQ ID NO: 6346 - protein, 13 aa, Artificial Sequence
  Synthetically generated peptide
CELCENGTCGGCY

SEQ ID NO: 6347 - protein, 13 aa, Artificial Sequence
  Synthetically generated peptide
CELCENGTCGACY

SEQ ID NO: 6348 - protein, 13 aa, Artificial Sequence
  Synthetically generated peptide
CELCGNPACTGCY

SEQ ID NO: 6349 - protein, 13 aa, Artificial Sequence
  Synthetically generated peptide
CELCGNPACTACY

SEQ ID NO: 6350 - protein, 13 aa, Artificial Sequence
  Synthetically generated peptide
CELCGNPACVGCY

SEQ ID NO: 6351 - protein, 13 aa, Artificial Sequence
  Synthetically generated peptide
CELCGNPACVACY

SEQ ID NO: 6352 - protein, 13 aa, Artificial Sequence
  Synthetically generated peptide
CELCGNPACGGCY

SEQ ID NO: 6353 - protein, 13 aa, Artificial Sequence
  Synthetically generated peptide
CELCGNPACGACY

SEQ ID NO: 6354 - protein, 13 aa, Artificial Sequence
  Synthetically generated peptide
CELCGNPTCTGCY

SEQ ID NO: 6355 - protein, 13 aa, Artificial Sequence
  Synthetically generated peptide
CELCGNPTCTACY

SEQ ID NO: 6356 - protein, 13 aa, Artificial Sequence
  Synthetically generated peptide
CELCGNPTCVGCY

SEQ ID NO: 6357 - protein, 13 aa, Artificial Sequence
  Synthetically generated peptide
CELCGNPTCVACY

SEQ ID NO: 6358 - protein, 13 aa, Artificial Sequence
  Synthetically generated peptide
CELCGNPTCGGCY

SEQ ID NO: 6359 - protein, 13 aa, Artificial Sequence
  Synthetically generated peptide
CELCGNPTCGACY

SEQ ID NO: 6360 - protein, 13 aa, Artificial Sequence
  Synthetically generated peptide
CELCGNGACTGCY

SEQ ID NO: 6361 - protein, 13 aa, Artificial Sequence
  Synthetically generated peptide
CELCGNGACTACY

SEQ ID NO: 6362 - protein, 13 aa, Artificial Sequence
  Synthetically generated peptide
CELCGNGACVGCY

SEQ ID NO: 6363 - protein, 13 aa, Artificial Sequence
  Synthetically generated peptide
CELCGNGACVACY

SEQ ID NO: 6364 - protein, 13 aa, Artificial Sequence
  Synthetically generated peptide
CELCGNGACGGCY

SEQ ID NO: 6365 - protein, 13 aa, Artificial Sequence
  Synthetically generated peptide
CELCGNGACGACY

SEQ ID NO: 6366 - protein, 13 aa, Artificial Sequence
  Synthetically generated peptide
CELCGNGTCTGCY

SEQ ID NO: 6367 - protein, 13 aa, Artificial Sequence
  Synthetically generated peptide
CELCGNGTCTACY

SEQ ID NO: 6368 - protein, 13 aa, Artificial Sequence
  Synthetically generated peptide
CELCGNGTCVGCY

SEQ ID NO: 6369 - protein, 13 aa, Artificial Sequence
  Synthetically generated peptide
CELCGNGTCVACY

SEQ ID NO: 6370 - protein, 13 aa, Artificial Sequence
  Synthetically generated peptide
CELCGNGTCGGCY

SEQ ID NO: 6371 - protein, 13 aa, Artificial Sequence
  Synthetically generated peptide
CELCGNGTCGACY

SEQ ID NO: 6372 - protein, 13 aa, Artificial Sequence
  Synthetically generated peptide
CELCHNPACTGCY

SEQ ID NO: 6373 - protein, 13 aa, Artificial Sequence
  Synthetically generated peptide
CELCHNPACTACY

SEQ ID NO: 6374 - protein, 13 aa, Artificial Sequence
  Synthetically generated peptide
CELCHNPACVGCY

SEQ ID NO: 6375 - protein, 13 aa, Artificial Sequence
  Synthetically generated peptide
CELCHNPACVACY

SEQ ID NO: 6376 - protein, 13 aa, Artificial Sequence
  Synthetically generated peptide
CELCHNPACGGCY

SEQ ID NO: 6377 - protein, 13 aa, Artificial Sequence
  Synthetically generated peptide
CELCHNPACGACY

SEQ ID NO: 6378 - protein, 13 aa, Artificial Sequence
  Synthetically generated peptide
CELCHNPTCTGCY

SEQ ID NO: 6379 - protein, 13 aa, Artificial Sequence
  Synthetically generated peptide
CELCHNPTCTACY

SEQ ID NO: 6380 - protein, 13 aa, Artificial Sequence
  Synthetically generated peptide
CELCHNPTCVGCY

SEQ ID NO: 6381 - protein, 13 aa, Artificial Sequence
  Synthetically generated peptide
CELCHNPTCVACY

SEQ ID NO: 6382 - protein, 13 aa, Artificial Sequence
  Synthetically generated peptide
CELCHNPTCGGCY

SEQ ID NO: 6383 - protein, 13 aa, Artificial Sequence
  Synthetically generated peptide
CELCHNPTCGACY

SEQ ID NO: 6384 - protein, 13 aa, Artificial Sequence
  Synthetically generated peptide
CELCHNGACTGCY

SEQ ID NO: 6385 - protein, 13 aa, Artificial Sequence
  Synthetically generated peptide
CELCHNGACTACY

SEQ ID NO: 6386 - protein, 13 aa, Artificial Sequence
  Synthetically generated peptide
CELCHNGACVGCY

SEQ ID NO: 6387 - protein, 13 aa, Artificial Sequence
  Synthetically generated peptide
CELCHNGACVACY

SEQ ID NO: 6388 - protein, 13 aa, Artificial Sequence
  Synthetically generated peptide
CELCHNGACGGCY

SEQ ID NO: 6389 - protein, 13 aa, Artificial Sequence
  Synthetically generated peptide
CELCHNGACGACY

SEQ ID NO: 6390 - protein, 13 aa, Artificial Sequence
  Synthetically generated peptide
CELCHNGTCTGCY

SEQ ID NO: 6391 - protein, 13 aa, Artificial Sequence
  Synthetically generated peptide
CELCHNGTCTACY

SEQ ID NO: 6392 - protein, 13 aa, Artificial Sequence
  Synthetically generated peptide
CELCHNGTCVGCY

SEQ ID NO: 6393 - protein, 13 aa, Artificial Sequence
  Synthetically generated peptide
CELCHNGTCVACY

SEQ ID NO: 6394 - protein, 13 aa, Artificial Sequence
  Synthetically generated peptide
CELCHNGTCGGCY

SEQ ID NO: 6395 - protein, 13 aa, Artificial Sequence
  Synthetically generated peptide
CELCHNGTCGACY

SEQ ID NO: 6396 - protein, 13 aa, Artificial Sequence
  Synthetically generated peptide
CELCINPACTGCY

SEQ ID NO: 6397 - protein, 13 aa, Artificial Sequence
  Synthetically generated peptide
CELCINPACTACY

SEQ ID NO: 6398 - protein, 13 aa, Artificial Sequence
  Synthetically generated peptide
CELCINPACVGCY

SEQ ID NO: 6399 - protein, 13 aa, Artificial Sequence
  Synthetically generated peptide
CELCINPACVACY

SEQ ID NO: 6400 - protein, 13 aa, Artificial Sequence
  Synthetically generated peptide
CELCINPACGGCY

SEQ ID NO: 6401 - protein, 13 aa, Artificial Sequence
  Synthetically generated peptide
CELCINPACGACY

SEQ ID NO: 6402 - protein, 13 aa, Artificial Sequence
  Synthetically generated peptide
CELCINPTCTGCY

SEQ ID NO: 6403 - protein, 13 aa, Artificial Sequence
  Synthetically generated peptide
CELCINPTCTACY

SEQ ID NO: 6404 - protein, 13 aa, Artificial Sequence
  Synthetically generated peptide
CELCINPTCVGCY

SEQ ID NO: 6405 - protein, 13 aa, Artificial Sequence
  Synthetically generated peptide
CELCINPTCVACY

SEQ ID NO: 6406 - protein, 13 aa, Artificial Sequence
  Synthetically generated peptide
CELCINPTCGGCY

SEQ ID NO: 6407 - protein, 13 aa, Artificial Sequence
  Synthetically generated peptide
CELCINPTCGACY

SEQ ID NO: 6408 - protein, 13 aa, Artificial Sequence
  Synthetically generated peptide
CELCINGACTGCY

SEQ ID NO: 6409 - protein, 13 aa, Artificial Sequence
  Synthetically generated peptide
CELCINGACTACY

SEQ ID NO: 6410 - protein, 13 aa, Artificial Sequence
  Synthetically generated peptide
CELCINGACVGCY

SEQ ID NO: 6411 - protein, 13 aa, Artificial Sequence
  Synthetically generated peptide
CELCINGACVACY

SEQ ID NO: 6412 - protein, 13 aa, Artificial Sequence
  Synthetically generated peptide
CELCINGACGGCY

SEQ ID NO: 6413 - protein, 13 aa, Artificial Sequence
  Synthetically generated peptide
CELCINGACGACY

SEQ ID NO: 6414 - protein, 13 aa, Artificial Sequence
  Synthetically generated peptide
CELCINGTCTGCY

SEQ ID NO: 6415 - protein, 13 aa, Artificial Sequence
  Synthetically generated peptide
CELCINGTCTACY

SEQ ID NO: 6416 - protein, 13 aa, Artificial Sequence
  Synthetically generated peptide
CELCINGTCVGCY

SEQ ID NO: 6417 - protein, 13 aa, Artificial Sequence
  Synthetically generated peptide
CELCINGTCVACY

SEQ ID NO: 6418 - protein, 13 aa, Artificial Sequence
  Synthetically generated peptide
CELCINGTCGGCY

SEQ ID NO: 6419 - protein, 13 aa, Artificial Sequence
  Synthetically generated peptide
CELCINGTCGACY

SEQ ID NO: 6420 - protein, 13 aa, Artificial Sequence
  Synthetically generated peptide
CELCLNPACTGCY

SEQ ID NO: 6421 - protein, 13 aa, Artificial Sequence
  Synthetically generated peptide
CELCLNPACTACY

SEQ ID NO: 6422 - protein, 13 aa, Artificial Sequence
  Synthetically generated peptide
CELCLNPACVGCY

SEQ ID NO: 6423 - protein, 13 aa, Artificial Sequence
  Synthetically generated peptide
CELCLNPACVACY

SEQ ID NO: 6424 - protein, 13 aa, Artificial Sequence
  Synthetically generated peptide
CELCLNPACGGCY

SEQ ID NO: 6425 - protein, 13 aa, Artificial Sequence
  Synthetically generated peptide
CELCLNPACGACY

SEQ ID NO: 6426 - protein, 13 aa, Artificial Sequence
  Synthetically generated peptide
CELCLNPTCTGCY

SEQ ID NO: 6427 - protein, 13 aa, Artificial Sequence
  Synthetically generated peptide
CELCLNPTCTACY

SEQ ID NO: 6428 - protein, 13 aa, Artificial Sequence
  Synthetically generated peptide
CELCLNPTCVGCY

SEQ ID NO: 6429 - protein, 13 aa, Artificial Sequence
  Synthetically generated peptide
CELCLNPTCVACY

SEQ ID NO: 6430 - protein, 13 aa, Artificial Sequence
  Synthetically generated peptide
CELCLNPTCGGCY

SEQ ID NO: 6431 - protein, 13 aa, Artificial Sequence
  Synthetically generated peptide
CELCLNPTCGACY

SEQ ID NO: 6432 - protein, 13 aa, Artificial Sequence
  Synthetically generated peptide
CELCLNGACTGCY

SEQ ID NO: 6433 - protein, 13 aa, Artificial Sequence
  Synthetically generated peptide
CELCLNGACTACY

SEQ ID NO: 6434 - protein, 13 aa, Artificial Sequence
  Synthetically generated peptide
CELCLNGACVGCY

SEQ ID NO: 6435 - protein, 13 aa, Artificial Sequence
  Synthetically generated peptide
CELCLNGACVACY

SEQ ID NO: 6436 - protein, 13 aa, Artificial Sequence
  Synthetically generated peptide
CELCLNGACGGCY

SEQ ID NO: 6437 - protein, 13 aa, Artificial Sequence
  Synthetically generated peptide
CELCLNGACGACY

SEQ ID NO: 6438 - protein, 13 aa, Artificial Sequence
  Synthetically generated peptide
CELCLNGTCTGCY

SEQ ID NO: 6439 - protein, 13 aa, Artificial Sequence
  Synthetically generated peptide
CELCLNGTCTACY

SEQ ID NO: 6440 - protein, 13 aa, Artificial Sequence
  Synthetically generated peptide
CELCLNGTCVGCY

SEQ ID NO: 6441 - protein, 13 aa, Artificial Sequence
  Synthetically generated peptide
CELCLNGTCVACY

SEQ ID NO: 6442 - protein, 13 aa, Artificial Sequence
  Synthetically generated peptide
CELCLNGTCGGCY

SEQ ID NO: 6443 - protein, 13 aa, Artificial Sequence
  Synthetically generated peptide
CELCLNGTCGACY

SEQ ID NO: 6444 - protein, 13 aa, Artificial Sequence
  Synthetically generated peptide
CELCKNPACTGCY

SEQ ID NO: 6445 - protein, 13 aa, Artificial Sequence
  Synthetically generated peptide
CELCKNPACTACY

SEQ ID NO: 6446 - protein, 13 aa, Artificial Sequence
  Synthetically generated peptide
CELCKNPACVGCY

SEQ ID NO: 6447 - protein, 13 aa, Artificial Sequence
  Synthetically generated peptide
CELCKNPACVACY

SEQ ID NO: 6448 - protein, 13 aa, Artificial Sequence
  Synthetically generated peptide
CELCKNPACGGCY

SEQ ID NO: 6449 - protein, 13 aa, Artificial Sequence
  Synthetically generated peptide
CELCKNPACGACY

SEQ ID NO: 6450 - protein, 13 aa, Artificial Sequence
  Synthetically generated peptide
CELCKNPTCTGCY

SEQ ID NO: 6451 - protein, 13 aa, Artificial Sequence
  Synthetically generated peptide
CELCKNPTCTACY

SEQ ID NO: 6452 - protein, 13 aa, Artificial Sequence
  Synthetically generated peptide
CELCKNPTCVGCY

SEQ ID NO: 6453 - protein, 13 aa, Artificial Sequence
  Synthetically generated peptide
CELCKNPTCVACY

SEQ ID NO: 6454 - protein, 13 aa, Artificial Sequence
  Synthetically generated peptide
CELCKNPTCGGCY

SEQ ID NO: 6455 - protein, 13 aa, Artificial Sequence
  Synthetically generated peptide
CELCKNPTCGACY

SEQ ID NO: 6456 - protein, 13 aa, Artificial Sequence
  Synthetically generated peptide
CELCKNGACTGCY

SEQ ID NO: 6457 - protein, 13 aa, Artificial Sequence
  Synthetically generated peptide
CELCKNGACTACY

SEQ ID NO: 6458 - protein, 13 aa, Artificial Sequence
  Synthetically generated peptide
CELCKNGACVGCY

SEQ ID NO: 6459 - protein, 13 aa, Artificial Sequence
  Synthetically generated peptide
CELCKNGACVACY

SEQ ID NO: 6460 - protein, 13 aa, Artificial Sequence
  Synthetically generated peptide
CELCKNGACGGCY

SEQ ID NO: 6461 - protein, 13 aa, Artificial Sequence
  Synthetically generated peptide
CELCKNGACGACY

SEQ ID NO: 6462 - protein, 13 aa, Artificial Sequence
  Synthetically generated peptide
CELCKNGTCTGCY

SEQ ID NO: 6463 - protein, 13 aa, Artificial Sequence
  Synthetically generated peptide
CELCKNGTCTACY

SEQ ID NO: 6464 - protein, 13 aa, Artificial Sequence
  Synthetically generated peptide
CELCKNGTCVGCY

SEQ ID NO: 6465 - protein, 13 aa, Artificial Sequence
  Synthetically generated peptide
CELCKNGTCVACY

SEQ ID NO: 6466 - protein, 13 aa, Artificial Sequence
  Synthetically generated peptide
CELCKNGTCGGCY

SEQ ID NO: 6467 - protein, 13 aa, Artificial Sequence
  Synthetically generated peptide
CELCKNGTCGACY

SEQ ID NO: 6468 - protein, 13 aa, Artificial Sequence
  Synthetically generated peptide
CELCMNPACTGCY

SEQ ID NO: 6469 - protein, 13 aa, Artificial Sequence
  Synthetically generated peptide
CELCMNPACTACY

SEQ ID NO: 6470 - protein, 13 aa, Artificial Sequence
  Synthetically generated peptide
CELCMNPACVGCY

SEQ ID NO: 6471 - protein, 13 aa, Artificial Sequence
  Synthetically generated peptide
CELCMNPACVACY

SEQ ID NO: 6472 - protein, 13 aa, Artificial Sequence
  Synthetically generated peptide
CELCMNPACGGCY

SEQ ID NO: 6473 - protein, 13 aa, Artificial Sequence
  Synthetically generated peptide
CELCMNPACGACY

SEQ ID NO: 6474 - protein, 13 aa, Artificial Sequence
  Synthetically generated peptide
CELCMNPTCTGCY

SEQ ID NO: 6475 - protein, 13 aa, Artificial Sequence
  Synthetically generated peptide
CELCMNPTCTACY

SEQ ID NO: 6476 - protein, 13 aa, Artificial Sequence
  Synthetically generated peptide
CELCMNPTCVGCY

SEQ ID NO: 6477 - protein, 13 aa, Artificial Sequence
  Synthetically generated peptide
CELCMNPTCVACY

SEQ ID NO: 6478 - protein, 13 aa, Artificial Sequence
  Synthetically generated peptide
CELCMNPTCGGCY

SEQ ID NO: 6479 - protein, 13 aa, Artificial Sequence
  Synthetically generated peptide
CELCMNPTCGACY

SEQ ID NO: 6480 - protein, 13 aa, Artificial Sequence
  Synthetically generated peptide
CELCMNGACTGCY

SEQ ID NO: 6481 - protein, 13 aa, Artificial Sequence
  Synthetically generated peptide
CELCMNGACTACY

SEQ ID NO: 6482 - protein, 13 aa, Artificial Sequence
  Synthetically generated peptide
CELCMNGACVGCY

SEQ ID NO: 6483 - protein, 13 aa, Artificial Sequence
  Synthetically generated peptide
CELCMNGACVACY

SEQ ID NO: 6484 - protein, 13 aa, Artificial Sequence
  Synthetically generated peptide
CELCMNGACGGCY

SEQ ID NO: 6485 - protein, 13 aa, Artificial Sequence
  Synthetically generated peptide
CELCMNGACGACY

SEQ ID NO: 6486 - protein, 13 aa, Artificial Sequence
  Synthetically generated peptide
CELCMNGTCTGCY

SEQ ID NO: 6487 - protein, 13 aa, Artificial Sequence
  Synthetically generated peptide
CELCMNGTCTACY

SEQ ID NO: 6488 - protein, 13 aa, Artificial Sequence
  Synthetically generated peptide
CELCMNGTCVGCY

SEQ ID NO: 6489 - protein, 13 aa, Artificial Sequence
  Synthetically generated peptide
CELCMNGTCVACY

SEQ ID NO: 6490 - protein, 13 aa, Artificial Sequence
  Synthetically generated peptide
CELCMNGTCGGCY

SEQ ID NO: 6491 - protein, 13 aa, Artificial Sequence
  Synthetically generated peptide
CELCMNGTCGACY

SEQ ID NO: 6492 - protein, 13 aa, Artificial Sequence
  Synthetically generated peptide
CELCFNPACTGCY

SEQ ID NO: 6493 - protein, 13 aa, Artificial Sequence
  Synthetically generated peptide
CELCFNPACTACY

SEQ ID NO: 6494 - protein, 13 aa, Artificial Sequence
  Synthetically generated peptide
CELCFNPACVGCY

SEQ ID NO: 6495 - protein, 13 aa, Artificial Sequence
  Synthetically generated peptide
CELCFNPACVACY

SEQ ID NO: 6496 - protein, 13 aa, Artificial Sequence
  Synthetically generated peptide
CELCFNPACGGCY

SEQ ID NO: 6497 - protein, 13 aa, Artificial Sequence
  Synthetically generated peptide
CELCFNPACGACY

SEQ ID NO: 6498 - protein, 13 aa, Artificial Sequence
  Synthetically generated peptide
CELCFNPTCTGCY

SEQ ID NO: 6499 - protein, 13 aa, Artificial Sequence
  Synthetically generated peptide
CELCFNPTCTACY

SEQ ID NO: 6500 - protein, 13 aa, Artificial Sequence
  Synthetically generated peptide
CELCFNPTCVGCY

SEQ ID NO: 6501 - protein, 13 aa, Artificial Sequence
  Synthetically generated peptide
CELCFNPTCVACY

SEQ ID NO: 6502 - protein, 13 aa, Artificial Sequence
  Synthetically generated peptide
CELCFNPTCGGCY

SEQ ID NO: 6503 - protein, 13 aa, Artificial Sequence
  Synthetically generated peptide
CELCFNPTCGACY

SEQ ID NO: 6504 - protein, 13 aa, Artificial Sequence
  Synthetically generated peptide
CELCFNGACTGCY

SEQ ID NO: 6505 - protein, 13 aa, Artificial Sequence
  Synthetically generated peptide
CELCFNGACTACY

SEQ ID NO: 6506 - protein, 13 aa, Artificial Sequence
  Synthetically generated peptide
CELCFNGACVGCY

SEQ ID NO: 6507 - protein, 13 aa, Artificial Sequence
  Synthetically generated peptide
CELCFNGACVACY

SEQ ID NO: 6508 - protein, 13 aa, Artificial Sequence
  Synthetically generated peptide
CELCFNGACGGCY

SEQ ID NO: 6509 - protein, 13 aa, Artificial Sequence
  Synthetically generated peptide
CELCFNGACGACY

SEQ ID NO: 6510 - protein, 13 aa, Artificial Sequence
  Synthetically generated peptide
CELCFNGTCTGCY

SEQ ID NO: 6511 - protein, 13 aa, Artificial Sequence
  Synthetically generated peptide
CELCFNGTCTACY

SEQ ID NO: 6512 - protein, 13 aa, Artificial Sequence
  Synthetically generated peptide
CELCFNGTCVGCY

SEQ ID NO: 6513 - protein, 13 aa, Artificial Sequence
  Synthetically generated peptide
CELCFNGTCVACY

SEQ ID NO: 6514 - protein, 13 aa, Artificial Sequence
  Synthetically generated peptide
CELCFNGTCGGCY

SEQ ID NO: 6515 - protein, 13 aa, Artificial Sequence
  Synthetically generated peptide
CELCFNGTCGACY

SEQ ID NO: 6516 - protein, 13 aa, Artificial Sequence
  Synthetically generated peptide
CELCPNPACTGCY

SEQ ID NO: 6517 - protein, 13 aa, Artificial Sequence
  Synthetically generated peptide
CELCPNPACTACY

SEQ ID NO: 6518 - protein, 13 aa, Artificial Sequence
  Synthetically generated peptide
CELCPNPACVGCY

SEQ ID NO: 6519 - protein, 13 aa, Artificial Sequence
  Synthetically generated peptide
CELCPNPACVACY

SEQ ID NO: 6520 - protein, 13 aa, Artificial Sequence
  Synthetically generated peptide
CELCPNPACGGCY

SEQ ID NO: 6521 - protein, 13 aa, Artificial Sequence
  Synthetically generated peptide
CELCPNPACGACY

SEQ ID NO: 6522 - protein, 13 aa, Artificial Sequence
  Synthetically generated peptide
CELCPNPTCTGCY

SEQ ID NO: 6523 - protein, 13 aa, Artificial Sequence
  Synthetically generated peptide
CELCPNPTCTACY

SEQ ID NO: 6524 - protein, 13 aa, Artificial Sequence
  Synthetically generated peptide
CELCPNPTCVGCY

SEQ ID NO: 6525 - protein, 13 aa, Artificial Sequence
  Synthetically generated peptide
CELCPNPTCVACY

SEQ ID NO: 6526 - protein, 13 aa, Artificial Sequence
  Synthetically generated peptide
CELCPNPTCGGCY

SEQ ID NO: 6527 - protein, 13 aa, Artificial Sequence
  Synthetically generated peptide
CELCPNPTCGACY

SEQ ID NO: 6528 - protein, 13 aa, Artificial Sequence
  Synthetically generated peptide
CELCPNGACTGCY

SEQ ID NO: 6529 - protein, 13 aa, Artificial Sequence
  Synthetically generated peptide
CELCPNGACTACY

SEQ ID NO: 6530 - protein, 13 aa, Artificial Sequence
  Synthetically generated peptide
CELCPNGACVGCY

SEQ ID NO: 6531 - protein, 13 aa, Artificial Sequence
  Synthetically generated peptide
CELCPNGACVACY

SEQ ID NO: 6532 - protein, 13 aa, Artificial Sequence
  Synthetically generated peptide
CELCPNGACGGCY

SEQ ID NO: 6533 - protein, 13 aa, Artificial Sequence
  Synthetically generated peptide
CELCPNGACGACY

SEQ ID NO: 6534 - protein, 13 aa, Artificial Sequence
  Synthetically generated peptide
CELCPNGTCTGCY

SEQ ID NO: 6535 - protein, 13 aa, Artificial Sequence
  Synthetically generated peptide
CELCPNGTCTACY

SEQ ID NO: 6536 - protein, 13 aa, Artificial Sequence
  Synthetically generated peptide
CELCPNGTCVGCY

SEQ ID NO: 6537 - protein, 13 aa, Artificial Sequence
  Synthetically generated peptide
CELCPNGTCVACY

SEQ ID NO: 6538 - protein, 13 aa, Artificial Sequence
  Synthetically generated peptide
CELCPNGTCGGCY

SEQ ID NO: 6539 - protein, 13 aa, Artificial Sequence
  Synthetically generated peptide
CELCPNGTCGACY

SEQ ID NO: 6540 - protein, 13 aa, Artificial Sequence
  Synthetically generated peptide
CELCSNPACTGCY

SEQ ID NO: 6541 - protein, 13 aa, Artificial Sequence
  Synthetically generated peptide
CELCSNPACTACY

SEQ ID NO: 6542 - protein, 13 aa, Artificial Sequence
  Synthetically generated peptide
CELCSNPACVGCY

SEQ ID NO: 6543 - protein, 13 aa, Artificial Sequence
  Synthetically generated peptide
CELCSNPACVACY

SEQ ID NO: 6544 - protein, 13 aa, Artificial Sequence
  Synthetically generated peptide
CELCSNPACGGCY

SEQ ID NO: 6545 - protein, 13 aa, Artificial Sequence
  Synthetically generated peptide
CELCSNPACGACY

SEQ ID NO: 6546 - protein, 13 aa, Artificial Sequence
  Synthetically generated peptide
CELCSNPTCTGCY

SEQ ID NO: 6547 - protein, 13 aa, Artificial Sequence
  Synthetically generated peptide
CELCSNPTCTACY

SEQ ID NO: 6548 - protein, 13 aa, Artificial Sequence
  Synthetically generated peptide
CELCSNPTCVGCY

SEQ ID NO: 6549 - protein, 13 aa, Artificial Sequence
  Synthetically generated peptide
CELCSNPTCVACY

SEQ ID NO: 6550 - protein, 13 aa, Artificial Sequence
  Synthetically generated peptide
CELCSNPTCGGCY

SEQ ID NO: 6551 - protein, 13 aa, Artificial Sequence
  Synthetically generated peptide
CELCSNPTCGACY

SEQ ID NO: 6552 - protein, 13 aa, Artificial Sequence
  Synthetically generated peptide
CELCSNGACTGCY

SEQ ID NO: 6553 - protein, 13 aa, Artificial Sequence
  Synthetically generated peptide
CELCSNGACTACY

SEQ ID NO: 6554 - protein, 13 aa, Artificial Sequence
  Synthetically generated peptide
CELCSNGACVGCY

SEQ ID NO: 6555 - protein, 13 aa, Artificial Sequence
  Synthetically generated peptide
CELCSNGACVACY

SEQ ID NO: 6556 - protein, 13 aa, Artificial Sequence
  Synthetically generated peptide
CELCSNGACGGCY

SEQ ID NO: 6557 - protein, 13 aa, Artificial Sequence
  Synthetically generated peptide
CELCSNGACGACY

SEQ ID NO: 6558 - protein, 13 aa, Artificial Sequence
  Synthetically generated peptide
CELCSNGTCTGCY

SEQ ID NO: 6559 - protein, 13 aa, Artificial Sequence
  Synthetically generated peptide
CELCSNGTCTACY

SEQ ID NO: 6560 - protein, 13 aa, Artificial Sequence
  Synthetically generated peptide
CELCSNGTCVGCY

SEQ ID NO: 6561 - protein, 13 aa, Artificial Sequence
  Synthetically generated peptide
CELCSNGTCVACY

SEQ ID NO: 6562 - protein, 13 aa, Artificial Sequence
  Synthetically generated peptide
CELCSNGTCGGCY

SEQ ID NO: 6563 - protein, 13 aa, Artificial Sequence
  Synthetically generated peptide
CELCSNGTCGACY

SEQ ID NO: 6564 - protein, 13 aa, Artificial Sequence
  Synthetically generated peptide
CELCTNPACTGCY

SEQ ID NO: 6565 - protein, 13 aa, Artificial Sequence
  Synthetically generated peptide
CELCTNPACTACY

SEQ ID NO: 6566 - protein, 13 aa, Artificial Sequence
  Synthetically generated peptide
CELCTNPACVGCY

SEQ ID NO: 6567 - protein, 13 aa, Artificial Sequence
  Synthetically generated peptide
CELCTNPACVACY

SEQ ID NO: 6568 - protein, 13 aa, Artificial Sequence
  Synthetically generated peptide
CELCTNPACGGCY

SEQ ID NO: 6569 - protein, 13 aa, Artificial Sequence
  Synthetically generated peptide
CELCTNPACGACY

SEQ ID NO: 6570 - protein, 13 aa, Artificial Sequence
  Synthetically generated peptide
CELCTNPTCTGCY

SEQ ID NO: 6571 - protein, 13 aa, Artificial Sequence
  Synthetically generated peptide
CELCTNPTCTACY

SEQ ID NO: 6572 - protein, 13 aa, Artificial Sequence
  Synthetically generated peptide
CELCTNPTCVGCY

SEQ ID NO: 6573 - protein, 13 aa, Artificial Sequence
  Synthetically generated peptide
CELCTNPTCVACY

SEQ ID NO: 6574 - protein, 13 aa, Artificial Sequence
  Synthetically generated peptide
CELCTNPTCGGCY

SEQ ID NO: 6575 - protein, 13 aa, Artificial Sequence
  Synthetically generated peptide
CELCTNPTCGACY

SEQ ID NO: 6576 - protein, 13 aa, Artificial Sequence
  Synthetically generated peptide
CELCTNGACTGCY

SEQ ID NO: 6577 - protein, 13 aa, Artificial Sequence
  Synthetically generated peptide
CELCTNGACTACY

SEQ ID NO: 6578 - protein, 13 aa, Artificial Sequence
  Synthetically generated peptide
CELCTNGACVGCY

SEQ ID NO: 6579 - protein, 13 aa, Artificial Sequence
  Synthetically generated peptide
CELCTNGACVACY

SEQ ID NO: 6580 - protein, 13 aa, Artificial Sequence
  Synthetically generated peptide
CELCTNGACGGCY

SEQ ID NO: 6581 - protein, 13 aa, Artificial Sequence
  Synthetically generated peptide
CELCTNGACGACY

SEQ ID NO: 6582 - protein, 13 aa, Artificial Sequence
  Synthetically generated peptide
CELCTNGTCTGCY

SEQ ID NO: 6583 - protein, 13 aa, Artificial Sequence
  Synthetically generated peptide
CELCTNGTCTACY

SEQ ID NO: 6584 - protein, 13 aa, Artificial Sequence
  Synthetically generated peptide
CELCTNGTCVGCY

SEQ ID NO: 6585 - protein, 13 aa, Artificial Sequence
  Synthetically generated peptide
CELCTNGTCVACY

SEQ ID NO: 6586 - protein, 13 aa, Artificial Sequence
  Synthetically generated peptide
CELCTNGTCGGCY

SEQ ID NO: 6587 - protein, 13 aa, Artificial Sequence
  Synthetically generated peptide
CELCTNGTCGACY

SEQ ID NO: 6588 - protein, 13 aa, Artificial Sequence
  Synthetically generated peptide
CELCWNPACTGCY

SEQ ID NO: 6589 - protein, 13 aa, Artificial Sequence
  Synthetically generated peptide
CELCWNPACTACY

SEQ ID NO: 6590 - protein, 13 aa, Artificial Sequence
  Synthetically generated peptide
CELCWNPACVGCY

SEQ ID NO: 6591 - protein, 13 aa, Artificial Sequence
  Synthetically generated peptide
CELCWNPACVACY

SEQ ID NO: 6592 - protein, 13 aa, Artificial Sequence
  Synthetically generated peptide
CELCWNPACGGCY

SEQ ID NO: 6593 - protein, 13 aa, Artificial Sequence
  Synthetically generated peptide
CELCWNPACGACY

SEQ ID NO: 6594 - protein, 13 aa, Artificial Sequence
  Synthetically generated peptide
CELCWNPTCTGCY

SEQ ID NO: 6595 - protein, 13 aa, Artificial Sequence
  Synthetically generated peptide
CELCWNPTCTACY

SEQ ID NO: 6596 - protein, 13 aa, Artificial Sequence
  Synthetically generated peptide
CELCWNPTCVGCY

SEQ ID NO: 6597 - protein, 13 aa, Artificial Sequence
  Synthetically generated peptide
CELCWNPTCVACY

SEQ ID NO: 6598 - protein, 13 aa, Artificial Sequence
  Synthetically generated peptide
CELCWNPTCGGCY

SEQ ID NO: 6599 - protein, 13 aa, Artificial Sequence
  Synthetically generated peptide
CELCWNPTCGACY

SEQ ID NO: 6600 - protein, 13 aa, Artificial Sequence
  Synthetically generated peptide
CELCWNGACTGCY

SEQ ID NO: 6601 - protein, 13 aa, Artificial Sequence
  Synthetically generated peptide
CELCWNGACTACY

SEQ ID NO: 6602 - protein, 13 aa, Artificial Sequence
  Synthetically generated peptide
CELCWNGACVGCY

SEQ ID NO: 6603 - protein, 13 aa, Artificial Sequence
  Synthetically generated peptide
CELCWNGACVACY

SEQ ID NO: 6604 - protein, 13 aa, Artificial Sequence
  Synthetically generated peptide
CELCWNGACGGCY

SEQ ID NO: 6605 - protein, 13 aa, Artificial Sequence
  Synthetically generated peptide
CELCWNGACGACY

SEQ ID NO: 6606 - protein, 13 aa, Artificial Sequence
  Synthetically generated peptide
CELCWNGTCTGCY

SEQ ID NO: 6607 - protein, 13 aa, Artificial Sequence
  Synthetically generated peptide
CELCWNGTCTACY

SEQ ID NO: 6608 - protein, 13 aa, Artificial Sequence
  Synthetically generated peptide
CELCWNGTCVGCY

SEQ ID NO: 6609 - protein, 13 aa, Artificial Sequence
  Synthetically generated peptide
CELCWNGTCVACY

SEQ ID NO: 6610 - protein, 13 aa, Artificial Sequence
  Synthetically generated peptide
CELCWNGTCGGCY

SEQ ID NO: 6611 - protein, 13 aa, Artificial Sequence
  Synthetically generated peptide
CELCWNGTCGACY

SEQ ID NO: 6612 - protein, 13 aa, Artificial Sequence
  Synthetically generated peptide
CELCYNPACTGCY

SEQ ID NO: 6613 - protein, 13 aa, Artificial Sequence
  Synthetically generated peptide
CELCYNPACTACY

SEQ ID NO: 6614 - protein, 13 aa, Artificial Sequence
  Synthetically generated peptide
CELCYNPACVGCY

SEQ ID NO: 6615 - protein, 13 aa, Artificial Sequence
  Synthetically generated peptide
CELCYNPACVACY

SEQ ID NO: 6616 - protein, 13 aa, Artificial Sequence
  Synthetically generated peptide
CELCYNPACGGCY

SEQ ID NO: 6617 - protein, 13 aa, Artificial Sequence
  Synthetically generated peptide
CELCYNPACGACY

SEQ ID NO: 6618 - protein, 13 aa, Artificial Sequence
  Synthetically generated peptide
CELCYNPTCTGCY

SEQ ID NO: 6619 - protein, 13 aa, Artificial Sequence
  Synthetically generated peptide
CELCYNPTCTACY

SEQ ID NO: 6620 - protein, 13 aa, Artificial Sequence
  Synthetically generated peptide
CELCYNPTCVGCY

SEQ ID NO: 6621 - protein, 13 aa, Artificial Sequence
  Synthetically generated peptide
CELCYNPTCVACY

SEQ ID NO: 6622 - protein, 13 aa, Artificial Sequence
  Synthetically generated peptide
CELCYNPTCGGCY

SEQ ID NO: 6623 - protein, 13 aa, Artificial Sequence
  Synthetically generated peptide
CELCYNPTCGACY

SEQ ID NO: 6624 - protein, 13 aa, Artificial Sequence
  Synthetically generated peptide
CELCYNGACTGCY

SEQ ID NO: 6625 - protein, 13 aa, Artificial Sequence
  Synthetically generated peptide
CELCYNGACTACY

SEQ ID NO: 6626 - protein, 13 aa, Artificial Sequence
  Synthetically generated peptide
CELCYNGACVGCY

SEQ ID NO: 6627 - protein, 13 aa, Artificial Sequence
  Synthetically generated peptide
CELCYNGACVACY

SEQ ID NO: 6628 - protein, 13 aa, Artificial Sequence
  Synthetically generated peptide
CELCYNGACGGCY

SEQ ID NO: 6629 - protein, 13 aa, Artificial Sequence
  Synthetically generated peptide
CELCYNGACGACY

SEQ ID NO: 6630 - protein, 13 aa, Artificial Sequence
  Synthetically generated peptide
CELCYNGTCTGCY

SEQ ID NO: 6631 - protein, 13 aa, Artificial Sequence
  Synthetically generated peptide
CELCYNGTCTACY

SEQ ID NO: 6632 - protein, 13 aa, Artificial Sequence
  Synthetically generated peptide
CELCYNGTCVGCY

SEQ ID NO: 6633 - protein, 13 aa, Artificial Sequence
  Synthetically generated peptide
CELCYNGTCVACY

SEQ ID NO: 6634 - protein, 13 aa, Artificial Sequence
  Synthetically generated peptide
CELCYNGTCGGCY

SEQ ID NO: 6635 - protein, 13 aa, Artificial Sequence
  Synthetically generated peptide
CELCYNGTCGACY

SEQ ID NO: 6636 - protein, 13 aa, Artificial Sequence
  Synthetically generated peptide
CELCVNPACTGCY

SEQ ID NO: 6637 - protein, 13 aa, Artificial Sequence
  Synthetically generated peptide
CELCVNPACTACY

SEQ ID NO: 6638 - protein, 13 aa, Artificial Sequence
  Synthetically generated peptide
CELCVNPACVGCY

SEQ ID NO: 6639 - protein, 13 aa, Artificial Sequence
  Synthetically generated peptide
CELCVNPACVACY

SEQ ID NO: 6640 - protein, 13 aa, Artificial Sequence
  Synthetically generated peptide
CELCVNPACGGCY

SEQ ID NO: 6641 - protein, 13 aa, Artificial Sequence
  Synthetically generated peptide
CELCVNPACGACY

SEQ ID NO: 6642 - protein, 13 aa, Artificial Sequence
  Synthetically generated peptide
CELCVNPTCTGCY

SEQ ID NO: 6643 - protein, 13 aa, Artificial Sequence
  Synthetically generated peptide
CELCVNPTCTACY

SEQ ID NO: 6644 - protein, 13 aa, Artificial Sequence
  Synthetically generated peptide
CELCVNPTCVGCY

SEQ ID NO: 6645 - protein, 13 aa, Artificial Sequence
  Synthetically generated peptide
CELCVNPTCVACY

SEQ ID NO: 6646 - protein, 13 aa, Artificial Sequence
  Synthetically generated peptide
CELCVNPTCGGCY

SEQ ID NO: 6647 - protein, 13 aa, Artificial Sequence
  Synthetically generated peptide
CELCVNPTCGACY

SEQ ID NO: 6648 - protein, 13 aa, Artificial Sequence
  Synthetically generated peptide
CELCVNGACTGCY

SEQ ID NO: 6649 - protein, 13 aa, Artificial Sequence
  Synthetically generated peptide
CELCVNGACTACY

SEQ ID NO: 6650 - protein, 13 aa, Artificial Sequence
  Synthetically generated peptide
CELCVNGACVGCY

SEQ ID NO: 6651 - protein, 13 aa, Artificial Sequence
  Synthetically generated peptide
CELCVNGACVACY

SEQ ID NO: 6652 - protein, 13 aa, Artificial Sequence
  Synthetically generated peptide
CELCVNGACGGCY

SEQ ID NO: 6653 - protein, 13 aa, Artificial Sequence
  Synthetically generated peptide
CELCVNGACGACY

SEQ ID NO: 6654 - protein, 13 aa, Artificial Sequence
  Synthetically generated peptide
CELCVNGTCTGCY

SEQ ID NO: 6655 - protein, 13 aa, Artificial Sequence
  Synthetically generated peptide
CELCVNGTCTACY

SEQ ID NO: 6656 - protein, 13 aa, Artificial Sequence
  Synthetically generated peptide
CELCVNGTCVGCY

SEQ ID NO: 6657 - protein, 13 aa, Artificial Sequence
  Synthetically generated peptide
CELCVNGTCVACY

SEQ ID NO: 6658 - protein, 13 aa, Artificial Sequence
  Synthetically generated peptide
CELCVNGTCGGCY

SEQ ID NO: 6659 - protein, 13 aa, Artificial Sequence
  Synthetically generated peptide
CELCVNGTCGACY

SEQ ID NO: 6660 - protein, 12 aa, Artificial Sequence
  Synthetically generated peptide
CELCNPACTGCY

SEQ ID NO: 6661 - protein, 12 aa, Artificial Sequence
  Synthetically generated peptide
CELCNPACTACY

SEQ ID NO: 6662 - protein, 12 aa, Artificial Sequence
  Synthetically generated peptide
CELCNPACVGCY

SEQ ID NO: 6663 - protein, 12 aa, Artificial Sequence
  Synthetically generated peptide
CELCNPACVACY

SEQ ID NO: 6664 - protein, 12 aa, Artificial Sequence
  Synthetically generated peptide
CELCNPACGGCY

SEQ ID NO: 6665 - protein, 12 aa, Artificial Sequence
  Synthetically generated peptide
CELCNPACGACY

SEQ ID NO: 6666 - protein, 12 aa, Artificial Sequence
  Synthetically generated peptide
CELCNPTCTGCY

SEQ ID NO: 6667 - protein, 12 aa, Artificial Sequence
  Synthetically generated peptide
CELCNPTCTACY

SEQ ID NO: 6668 - protein, 12 aa, Artificial Sequence
  Synthetically generated peptide
CELCNPTCVGCY

SEQ ID NO: 6669 - protein, 12 aa, Artificial Sequence
  Synthetically generated peptide
CELCNPTCVACY

SEQ ID NO: 6670 - protein, 12 aa, Artificial Sequence
  Synthetically generated peptide
CELCNPTCGGCY

SEQ ID NO: 6671 - protein, 12 aa, Artificial Sequence
  Synthetically generated peptide
CELCNPTCGACY

SEQ ID NO: 6672 - protein, 12 aa, Artificial Sequence
  Synthetically generated peptide
CELCNGACTGCY

SEQ ID NO: 6673 - protein, 12 aa, Artificial Sequence
  Synthetically generated peptide
CELCNGACTACY

SEQ ID NO: 6674 - protein, 12 aa, Artificial Sequence
  Synthetically generated peptide
CELCNGACVGCY

SEQ ID NO: 6675 - protein, 12 aa, Artificial Sequence
  Synthetically generated peptide
CELCNGACVACY

SEQ ID NO: 6676 - protein, 12 aa, Artificial Sequence
  Synthetically generated peptide
CELCNGACGGCY

SEQ ID NO: 6677 - protein, 12 aa, Artificial Sequence
  Synthetically generated peptide
CELCNGACGACY

SEQ ID NO: 6678 - protein, 12 aa, Artificial Sequence
  Synthetically generated peptide
CELCNGTCTGCY

SEQ ID NO: 6679 - protein, 12 aa, Artificial Sequence
  Synthetically generated peptide
CELCNGTCTACY

SEQ ID NO: 6680 - protein, 12 aa, Artificial Sequence
  Synthetically generated peptide
CELCNGTCVGCY

SEQ ID NO: 6681 - protein, 12 aa, Artificial Sequence
  Synthetically generated peptide
CELCNGTCVACY

SEQ ID NO: 6682 - protein, 12 aa, Artificial Sequence
  Synthetically generated peptide
CELCNGTCGGCY

SEQ ID NO: 6683 - protein, 12 aa, Artificial Sequence
  Synthetically generated peptide
CELCNGTCGACY

SEQ ID NO: 6684 - protein, 12 aa, Artificial Sequence
  Synthetically generated peptide
CEYCANPACTGC

SEQ ID NO: 6685 - protein, 12 aa, Artificial Sequence
  Synthetically generated peptide
CEYCANPACTAC

SEQ ID NO: 6686 - protein, 12 aa, Artificial Sequence
  Synthetically generated peptide
CEYCANPACVGC

SEQ ID NO: 6687 - protein, 12 aa, Artificial Sequence
  Synthetically generated peptide
CEYCANPACVAC

SEQ ID NO: 6688 - protein, 12 aa, Artificial Sequence
  Synthetically generated peptide
CEYCANPACGGC

SEQ ID NO: 6689 - protein, 12 aa, Artificial Sequence
  Synthetically generated peptide
CEYCANPACGAC

SEQ ID NO: 6690 - protein, 12 aa, Artificial Sequence
  Synthetically generated peptide
CEYCANPTCTGC

SEQ ID NO: 6691 - protein, 12 aa, Artificial Sequence
  Synthetically generated peptide
CEYCANPTCTAC

SEQ ID NO: 6692 - protein, 12 aa, Artificial Sequence
  Synthetically generated peptide
CEYCANPTCVGC

SEQ ID NO: 6693 - protein, 12 aa, Artificial Sequence
  Synthetically generated peptide
CEYCANPTCVAC

SEQ ID NO: 6694 - protein, 12 aa, Artificial Sequence
  Synthetically generated peptide
CEYCANPTCGGC

SEQ ID NO: 6695 - protein, 12 aa, Artificial Sequence
  Synthetically generated peptide
CEYCANPTCGAC

SEQ ID NO: 6696 - protein, 12 aa, Artificial Sequence
  Synthetically generated peptide
CEYCANGACTGC

SEQ ID NO: 6697 - protein, 12 aa, Artificial Sequence
  Synthetically generated peptide
CEYCANGACTAC

SEQ ID NO: 6698 - protein, 12 aa, Artificial Sequence
  Synthetically generated peptide
CEYCANGACVGC

SEQ ID NO: 6699 - protein, 12 aa, Artificial Sequence
  Synthetically generated peptide
CEYCANGACVAC

SEQ ID NO: 6700 - protein, 12 aa, Artificial Sequence
  Synthetically generated peptide
CEYCANGACGGC

SEQ ID NO: 6701 - protein, 12 aa, Artificial Sequence
  Synthetically generated peptide
CEYCANGACGAC

SEQ ID NO: 6702 - protein, 12 aa, Artificial Sequence
  Synthetically generated peptide
CEYCANGTCTGC

SEQ ID NO: 6703 - protein, 12 aa, Artificial Sequence
  Synthetically generated peptide
CEYCANGTCTAC

SEQ ID NO: 6704 - protein, 12 aa, Artificial Sequence
  Synthetically generated peptide
CEYCANGTCVGC

SEQ ID NO: 6705 - protein, 12 aa, Artificial Sequence
  Synthetically generated peptide
CEYCANGTCVAC

SEQ ID NO: 6706 - protein, 12 aa, Artificial Sequence
  Synthetically generated peptide
CEYCANGTCGGC

SEQ ID NO: 6707 - protein, 12 aa, Artificial Sequence
  Synthetically generated peptide
CEYCANGTCGAC

SEQ ID NO: 6708 - protein, 12 aa, Artificial Sequence
  Synthetically generated peptide
CEYCRNPACTGC

SEQ ID NO: 6709 - protein, 12 aa, Artificial Sequence
  Synthetically generated peptide
CEYCRNPACTAC

SEQ ID NO: 6710 - protein, 12 aa, Artificial Sequence
  Synthetically generated peptide
CEYCRNPACVGC

SEQ ID NO: 6711 - protein, 12 aa, Artificial Sequence
  Synthetically generated peptide
CEYCRNPACVAC

SEQ ID NO: 6712 - protein, 12 aa, Artificial Sequence
  Synthetically generated peptide
CEYCRNPACGGC

SEQ ID NO: 6713 - protein, 12 aa, Artificial Sequence
  Synthetically generated peptide
CEYCRNPACGAC

SEQ ID NO: 6714 - protein, 12 aa, Artificial Sequence
  Synthetically generated peptide
CEYCRNPTCTGC

SEQ ID NO: 6715 - protein, 12 aa, Artificial Sequence
  Synthetically generated peptide
CEYCRNPTCTAC

SEQ ID NO: 6716 - protein, 12 aa, Artificial Sequence
  Synthetically generated peptide
CEYCRNPTCVGC

SEQ ID NO: 6717 - protein, 12 aa, Artificial Sequence
  Synthetically generated peptide
CEYCRNPTCVAC

SEQ ID NO: 6718 - protein, 12 aa, Artificial Sequence
  Synthetically generated peptide
CEYCRNPTCGGC

SEQ ID NO: 6719 - protein, 12 aa, Artificial Sequence
  Synthetically generated peptide
CEYCRNPTCGAC

SEQ ID NO: 6720 - protein, 12 aa, Artificial Sequence
  Synthetically generated peptide
CEYCRNGACTGC

SEQ ID NO: 6721 - protein, 12 aa, Artificial Sequence
  Synthetically generated peptide
CEYCRNGACTAC

SEQ ID NO: 6722 - protein, 12 aa, Artificial Sequence
  Synthetically generated peptide
CEYCRNGACVGC

SEQ ID NO: 6723 - protein, 12 aa, Artificial Sequence
  Synthetically generated peptide
CEYCRNGACVAC

SEQ ID NO: 6724 - protein, 12 aa, Artificial Sequence
  Synthetically generated peptide
CEYCRNGACGGC

SEQ ID NO: 6725 - protein, 12 aa, Artificial Sequence
  Synthetically generated peptide
CEYCRNGACGAC

SEQ ID NO: 6726 - protein, 12 aa, Artificial Sequence
  Synthetically generated peptide
CEYCRNGTCTGC

SEQ ID NO: 6727 - protein, 12 aa, Artificial Sequence
  Synthetically generated peptide
CEYCRNGTCTAC

SEQ ID NO: 6728 - protein, 12 aa, Artificial Sequence
  Synthetically generated peptide
CEYCRNGTCVGC

SEQ ID NO: 6729 - protein, 12 aa, Artificial Sequence
  Synthetically generated peptide
CEYCRNGTCVAC

SEQ ID NO: 6730 - protein, 12 aa, Artificial Sequence
  Synthetically generated peptide
CEYCRNGTCGGC

SEQ ID NO: 6731 - protein, 12 aa, Artificial Sequence
  Synthetically generated peptide
CEYCRNGTCGAC

SEQ ID NO: 6732 - protein, 12 aa, Artificial Sequence
  Synthetically generated peptide
CEYCNNPACTGC

SEQ ID NO: 6733 - protein, 12 aa, Artificial Sequence
  Synthetically generated peptide
CEYCNNPACTAC

SEQ ID NO: 6734 - protein, 12 aa, Artificial Sequence
  Synthetically generated peptide
CEYCNNPACVGC

SEQ ID NO: 6735 - protein, 12 aa, Artificial Sequence
  Synthetically generated peptide
CEYCNNPACVAC

SEQ ID NO: 6736 - protein, 12 aa, Artificial Sequence
  Synthetically generated peptide
CEYCNNPACGGC

SEQ ID NO: 6737 - protein, 12 aa, Artificial Sequence
  Synthetically generated peptide
CEYCNNPACGAC

SEQ ID NO: 6738 - protein, 12 aa, Artificial Sequence
  Synthetically generated peptide
CEYCNNPTCTGC

SEQ ID NO: 6739 - protein, 12 aa, Artificial Sequence
  Synthetically generated peptide
CEYCNNPTCTAC

SEQ ID NO: 6740 - protein, 12 aa, Artificial Sequence
  Synthetically generated peptide
CEYCNNPTCVGC

SEQ ID NO: 6741 - protein, 12 aa, Artificial Sequence
  Synthetically generated peptide
CEYCNNPTCVAC

SEQ ID NO: 6742 - protein, 12 aa, Artificial Sequence
  Synthetically generated peptide
CEYCNNPTCGGC

SEQ ID NO: 6743 - protein, 12 aa, Artificial Sequence
  Synthetically generated peptide
CEYCNNPTCGAC

SEQ ID NO: 6744 - protein, 12 aa, Artificial Sequence
  Synthetically generated peptide
CEYCNNGACTGC

SEQ ID NO: 6745 - protein, 12 aa, Artificial Sequence
  Synthetically generated peptide
CEYCNNGACTAC

SEQ ID NO: 6746 - protein, 12 aa, Artificial Sequence
  Synthetically generated peptide
CEYCNNGACVGC

SEQ ID NO: 6747 - protein, 12 aa, Artificial Sequence
  Synthetically generated peptide
CEYCNNGACVAC

SEQ ID NO: 6748 - protein, 12 aa, Artificial Sequence
  Synthetically generated peptide
CEYCNNGACGGC

SEQ ID NO: 6749 - protein, 12 aa, Artificial Sequence
  Synthetically generated peptide
CEYCNNGACGAC

SEQ ID NO: 6750 - protein, 12 aa, Artificial Sequence
  Synthetically generated peptide
CEYCNNGTCTGC

SEQ ID NO: 6751 - protein, 12 aa, Artificial Sequence
  Synthetically generated peptide
CEYCNNGTCTAC

SEQ ID NO: 6752 - protein, 12 aa, Artificial Sequence
  Synthetically generated peptide
CEYCNNGTCVGC

SEQ ID NO: 6753 - protein, 12 aa, Artificial Sequence
  Synthetically generated peptide
CEYCNNGTCVAC

SEQ ID NO: 6754 - protein, 12 aa, Artificial Sequence
  Synthetically generated peptide
CEYCNNGTCGGC

SEQ ID NO: 6755 - protein, 12 aa, Artificial Sequence
  Synthetically generated peptide
CEYCNNGTCGAC

SEQ ID NO: 6756 - protein, 12 aa, Artificial Sequence
  Synthetically generated peptide
CEYCDNPACTGC

SEQ ID NO: 6757 - protein, 12 aa, Artificial Sequence
  Synthetically generated peptide
CEYCDNPACTAC

SEQ ID NO: 6758 - protein, 12 aa, Artificial Sequence
  Synthetically generated peptide
CEYCDNPACVGC

SEQ ID NO: 6759 - protein, 12 aa, Artificial Sequence
  Synthetically generated peptide
CEYCDNPACVAC

SEQ ID NO: 6760 - protein, 12 aa, Artificial Sequence
  Synthetically generated peptide
CEYCDNPACGGC

SEQ ID NO: 6761 - protein, 12 aa, Artificial Sequence
  Synthetically generated peptide
CEYCDNPACGAC

SEQ ID NO: 6762 - protein, 12 aa, Artificial Sequence
  Synthetically generated peptide
CEYCDNPTCTGC

SEQ ID NO: 6763 - protein, 12 aa, Artificial Sequence
  Synthetically generated peptide
CEYCDNPTCTAC

SEQ ID NO: 6764 - protein, 12 aa, Artificial Sequence
  Synthetically generated peptide
CEYCDNPTCVGC

SEQ ID NO: 6765 - protein, 12 aa, Artificial Sequence
  Synthetically generated peptide
CEYCDNPTCVAC

SEQ ID NO: 6766 - protein, 12 aa, Artificial Sequence
  Synthetically generated peptide
CEYCDNPTCGGC

SEQ ID NO: 6767 - protein, 12 aa, Artificial Sequence
  Synthetically generated peptide
CEYCDNPTCGAC

SEQ ID NO: 6768 - protein, 12 aa, Artificial Sequence
  Synthetically generated peptide
CEYCDNGACTGC

SEQ ID NO: 6769 - protein, 12 aa, Artificial Sequence
  Synthetically generated peptide
CEYCDNGACTAC

SEQ ID NO: 6770 - protein, 12 aa, Artificial Sequence
  Synthetically generated peptide
CEYCDNGACVGC

SEQ ID NO: 6771 - protein, 12 aa, Artificial Sequence
  Synthetically generated peptide
CEYCDNGACVAC

SEQ ID NO: 6772 - protein, 12 aa, Artificial Sequence
  Synthetically generated peptide
CEYCDNGACGGC

SEQ ID NO: 6773 - protein, 12 aa, Artificial Sequence
  Synthetically generated peptide
CEYCDNGACGAC

SEQ ID NO: 6774 - protein, 12 aa, Artificial Sequence
  Synthetically generated peptide
CEYCDNGTCTGC

SEQ ID NO: 6775 - protein, 12 aa, Artificial Sequence
  Synthetically generated peptide
CEYCDNGTCTAC

SEQ ID NO: 6776 - protein, 12 aa, Artificial Sequence
  Synthetically generated peptide
CEYCDNGTCVGC

SEQ ID NO: 6777 - protein, 12 aa, Artificial Sequence
  Synthetically generated peptide
CEYCDNGTCVAC

SEQ ID NO: 6778 - protein, 12 aa, Artificial Sequence
  Synthetically generated peptide
CEYCDNGTCGGC

SEQ ID NO: 6779 - protein, 12 aa, Artificial Sequence
  Synthetically generated peptide
CEYCDNGTCGAC

SEQ ID NO: 6780 - protein, 12 aa, Artificial Sequence
  Synthetically generated peptide
CEYCQNPACTGC

SEQ ID NO: 6781 - protein, 12 aa, Artificial Sequence
  Synthetically generated peptide
CEYCQNPACTAC

SEQ ID NO: 6782 - protein, 12 aa, Artificial Sequence
  Synthetically generated peptide
CEYCQNPACVGC

SEQ ID NO: 6783 - protein, 12 aa, Artificial Sequence
  Synthetically generated peptide
CEYCQNPACVAC

SEQ ID NO: 6784 - protein, 12 aa, Artificial Sequence
  Synthetically generated peptide
CEYCQNPACGGC

SEQ ID NO: 6785 - protein, 12 aa, Artificial Sequence
  Synthetically generated peptide
CEYCQNPACGAC

SEQ ID NO: 6786 - protein, 12 aa, Artificial Sequence
  Synthetically generated peptide
CEYCQNPTCTGC

SEQ ID NO: 6787 - protein, 12 aa, Artificial Sequence
  Synthetically generated peptide
CEYCQNPTCTAC

SEQ ID NO: 6788 - protein, 12 aa, Artificial Sequence
  Synthetically generated peptide
CEYCQNPTCVGC

SEQ ID NO: 6789 - protein, 12 aa, Artificial Sequence
  Synthetically generated peptide
CEYCQNPTCVAC

SEQ ID NO: 6790 - protein, 12 aa, Artificial Sequence
  Synthetically generated peptide
CEYCQNPTCGGC

SEQ ID NO: 6791 - protein, 12 aa, Artificial Sequence
  Synthetically generated peptide
CEYCQNPTCGAC

SEQ ID NO: 6792 - protein, 12 aa, Artificial Sequence
  Synthetically generated peptide
CEYCQNGACTGC

SEQ ID NO: 6793 - protein, 12 aa, Artificial Sequence
  Synthetically generated peptide
CEYCQNGACTAC

SEQ ID NO: 6794 - protein, 12 aa, Artificial Sequence
  Synthetically generated peptide
CEYCQNGACVGC

SEQ ID NO: 6795 - protein, 12 aa, Artificial Sequence
  Synthetically generated peptide
CEYCQNGACVAC

SEQ ID NO: 6796 - protein, 12 aa, Artificial Sequence
  Synthetically generated peptide
CEYCQNGACGGC

SEQ ID NO: 6797 - protein, 12 aa, Artificial Sequence
  Synthetically generated peptide
CEYCQNGACGAC

SEQ ID NO: 6798 - protein, 12 aa, Artificial Sequence
  Synthetically generated peptide
CEYCQNGTCTGC

SEQ ID NO: 6799 - protein, 12 aa, Artificial Sequence
  Synthetically generated peptide
CEYCQNGTCTAC

SEQ ID NO: 6800 - protein, 12 aa, Artificial Sequence
  Synthetically generated peptide
CEYCQNGTCVGC

SEQ ID NO: 6801 - protein, 12 aa, Artificial Sequence
  Synthetically generated peptide
CEYCQNGTCVAC

SEQ ID NO: 6802 - protein, 12 aa, Artificial Sequence
  Synthetically generated peptide
CEYCQNGTCGGC

SEQ ID NO: 6803 - protein, 12 aa, Artificial Sequence
  Synthetically generated peptide
CEYCQNGTCGAC

SEQ ID NO: 6804 - protein, 12 aa, Artificial Sequence
  Synthetically generated peptide
CEYCENPACTGC

SEQ ID NO: 6805 - protein, 12 aa, Artificial Sequence
  Synthetically generated peptide
CEYCENPACTAC

SEQ ID NO: 6806 - protein, 12 aa, Artificial Sequence
  Synthetically generated peptide
CEYCENPACVGC

SEQ ID NO: 6807 - protein, 12 aa, Artificial Sequence
  Synthetically generated peptide
CEYCENPACVAC

SEQ ID NO: 6808 - protein, 12 aa, Artificial Sequence
  Synthetically generated peptide
CEYCENPACGGC

SEQ ID NO: 6809 - protein, 12 aa, Artificial Sequence
  Synthetically generated peptide
CEYCENPACGAC

SEQ ID NO: 6810 - protein, 12 aa, Artificial Sequence
  Synthetically generated peptide
CEYCENPTCTGC

SEQ ID NO: 6811 - protein, 12 aa, Artificial Sequence
  Synthetically generated peptide
CEYCENPTCTAC

SEQ ID NO: 6812 - protein, 12 aa, Artificial Sequence
  Synthetically generated peptide
CEYCENPTCVGC

SEQ ID NO: 6813 - protein, 12 aa, Artificial Sequence
  Synthetically generated peptide
CEYCENPTCVAC

SEQ ID NO: 6814 - protein, 12 aa, Artificial Sequence
  Synthetically generated peptide
CEYCENPTCGGC

SEQ ID NO: 6815 - protein, 12 aa, Artificial Sequence
  Synthetically generated peptide
CEYCENPTCGAC

SEQ ID NO: 6816 - protein, 12 aa, Artificial Sequence
  Synthetically generated peptide
CEYCENGACTGC

SEQ ID NO: 6817 - protein, 12 aa, Artificial Sequence
  Synthetically generated peptide
CEYCENGACTAC

SEQ ID NO: 6818 - protein, 12 aa, Artificial Sequence
  Synthetically generated peptide
CEYCENGACVGC

SEQ ID NO: 6819 - protein, 12 aa, Artificial Sequence
  Synthetically generated peptide
CEYCENGACVAC

SEQ ID NO: 6820 - protein, 12 aa, Artificial Sequence
  Synthetically generated peptide
CEYCENGACGGC

SEQ ID NO: 6821 - protein, 12 aa, Artificial Sequence
  Synthetically generated peptide
CEYCENGACGAC

SEQ ID NO: 6822 - protein, 12 aa, Artificial Sequence
  Synthetically generated peptide
CEYCENGTCTGC

SEQ ID NO: 6823 - protein, 12 aa, Artificial Sequence
  Synthetically generated peptide
CEYCENGTCTAC

SEQ ID NO: 6824 - protein, 12 aa, Artificial Sequence
  Synthetically generated peptide
CEYCENGTCVGC

SEQ ID NO: 6825 - protein, 12 aa, Artificial Sequence
  Synthetically generated peptide
CEYCENGTCVAC

SEQ ID NO: 6826 - protein, 12 aa, Artificial Sequence
  Synthetically generated peptide
CEYCENGTCGGC

SEQ ID NO: 6827 - protein, 12 aa, Artificial Sequence
  Synthetically generated peptide
CEYCENGTCGAC

SEQ ID NO: 6828 - protein, 12 aa, Artificial Sequence
  Synthetically generated peptide
CEYCGNPACTGC

SEQ ID NO: 6829 - protein, 12 aa, Artificial Sequence
  Synthetically generated peptide
CEYCGNPACTAC

SEQ ID NO: 6830 - protein, 12 aa, Artificial Sequence
  Synthetically generated peptide
CEYCGNPACVGC

SEQ ID NO: 6831 - protein, 12 aa, Artificial Sequence
  Synthetically generated peptide
CEYCGNPACVAC

SEQ ID NO: 6832 - protein, 12 aa, Artificial Sequence
  Synthetically generated peptide
CEYCGNPACGGC

SEQ ID NO: 6833 - protein, 12 aa, Artificial Sequence
  Synthetically generated peptide
CEYCGNPACGAC

SEQ ID NO: 6834 - protein, 12 aa, Artificial Sequence
  Synthetically generated peptide
CEYCGNPTCTGC

SEQ ID NO: 6835 - protein, 12 aa, Artificial Sequence
  Synthetically generated peptide
CEYCGNPTCTAC

SEQ ID NO: 6836 - protein, 12 aa, Artificial Sequence
  Synthetically generated peptide
CEYCGNPTCVGC

SEQ ID NO: 6837 - protein, 12 aa, Artificial Sequence
  Synthetically generated peptide
CEYCGNPTCVAC

SEQ ID NO: 6838 - protein, 12 aa, Artificial Sequence
  Synthetically generated peptide
CEYCGNPTCGGC

SEQ ID NO: 6839 - protein, 12 aa, Artificial Sequence
  Synthetically generated peptide
CEYCGNPTCGAC

SEQ ID NO: 6840 - protein, 12 aa, Artificial Sequence
  Synthetically generated peptide
CEYCGNGACTGC

SEQ ID NO: 6841 - protein, 12 aa, Artificial Sequence
  Synthetically generated peptide
CEYCGNGACTAC

SEQ ID NO: 6842 - protein, 12 aa, Artificial Sequence
  Synthetically generated peptide
CEYCGNGACVGC

SEQ ID NO: 6843 - protein, 12 aa, Artificial Sequence
  Synthetically generated peptide
CEYCGNGACVAC

SEQ ID NO: 6844 - protein, 12 aa, Artificial Sequence
  Synthetically generated peptide
CEYCGNGACGGC

SEQ ID NO: 6845 - protein, 12 aa, Artificial Sequence
  Synthetically generated peptide
CEYCGNGACGAC

SEQ ID NO: 6846 - protein, 12 aa, Artificial Sequence
  Synthetically generated peptide
CEYCGNGTCTGC

SEQ ID NO: 6847 - protein, 12 aa, Artificial Sequence
  Synthetically generated peptide
CEYCGNGTCTAC

SEQ ID NO: 6848 - protein, 12 aa, Artificial Sequence
  Synthetically generated peptide
CEYCGNGTCVGC

SEQ ID NO: 6849 - protein, 12 aa, Artificial Sequence
  Synthetically generated peptide
CEYCGNGTCVAC

SEQ ID NO: 6850 - protein, 12 aa, Artificial Sequence
  Synthetically generated peptide
CEYCGNGTCGGC

SEQ ID NO: 6851 - protein, 12 aa, Artificial Sequence
  Synthetically generated peptide
CEYCGNGTCGAC

SEQ ID NO: 6852 - protein, 12 aa, Artificial Sequence
  Synthetically generated peptide
CEYCHNPACTGC

SEQ ID NO: 6853 - protein, 12 aa, Artificial Sequence
  Synthetically generated peptide
CEYCHNPACTAC

SEQ ID NO: 6854 - protein, 12 aa, Artificial Sequence
  Synthetically generated peptide
CEYCHNPACVGC

SEQ ID NO: 6855 - protein, 12 aa, Artificial Sequence
  Synthetically generated peptide
CEYCHNPACVAC

SEQ ID NO: 6856 - protein, 12 aa, Artificial Sequence
  Synthetically generated peptide
CEYCHNPACGGC

SEQ ID NO: 6857 - protein, 12 aa, Artificial Sequence
  Synthetically generated peptide
CEYCHNPACGAC

SEQ ID NO: 6858 - protein, 12 aa, Artificial Sequence
  Synthetically generated peptide
CEYCHNPTCTGC

SEQ ID NO: 6859 - protein, 12 aa, Artificial Sequence
  Synthetically generated peptide
CEYCHNPTCTAC

SEQ ID NO: 6860 - protein, 12 aa, Artificial Sequence
  Synthetically generated peptide
CEYCHNPTCVGC

SEQ ID NO: 6861 - protein, 12 aa, Artificial Sequence
  Synthetically generated peptide
CEYCHNPTCVAC

SEQ ID NO: 6862 - protein, 12 aa, Artificial Sequence
  Synthetically generated peptide
CEYCHNPTCGGC

SEQ ID NO: 6863 - protein, 12 aa, Artificial Sequence
  Synthetically generated peptide
CEYCHNPTCGAC

SEQ ID NO: 6864 - protein, 12 aa, Artificial Sequence
  Synthetically generated peptide
CEYCHNGACTGC

SEQ ID NO: 6865 - protein, 12 aa, Artificial Sequence
  Synthetically generated peptide
CEYCHNGACTAC

SEQ ID NO: 6866 - protein, 12 aa, Artificial Sequence
  Synthetically generated peptide
CEYCHNGACVGC

SEQ ID NO: 6867 - protein, 12 aa, Artificial Sequence
  Synthetically generated peptide
CEYCHNGACVAC

SEQ ID NO: 6868 - protein, 12 aa, Artificial Sequence
  Synthetically generated peptide
CEYCHNGACGGC

SEQ ID NO: 6869 - protein, 12 aa, Artificial Sequence
  Synthetically generated peptide
CEYCHNGACGAC

SEQ ID NO: 6870 - protein, 12 aa, Artificial Sequence
  Synthetically generated peptide
CEYCHNGTCTGC

SEQ ID NO: 6871 - protein, 12 aa, Artificial Sequence
  Synthetically generated peptide
CEYCHNGTCTAC

SEQ ID NO: 6872 - protein, 12 aa, Artificial Sequence
  Synthetically generated peptide
CEYCHNGTCVGC

SEQ ID NO: 6873 - protein, 12 aa, Artificial Sequence
  Synthetically generated peptide
CEYCHNGTCVAC

SEQ ID NO: 6874 - protein, 12 aa, Artificial Sequence
  Synthetically generated peptide
CEYCHNGTCGGC

SEQ ID NO: 6875 - protein, 12 aa, Artificial Sequence
  Synthetically generated peptide
CEYCHNGTCGAC

SEQ ID NO: 6876 - protein, 12 aa, Artificial Sequence
  Synthetically generated peptide
CEYCINPACTGC

SEQ ID NO: 6877 - protein, 12 aa, Artificial Sequence
  Synthetically generated peptide
CEYCINPACTAC

SEQ ID NO: 6878 - protein, 12 aa, Artificial Sequence
  Synthetically generated peptide
CEYCINPACVGC

SEQ ID NO: 6879 - protein, 12 aa, Artificial Sequence
  Synthetically generated peptide
CEYCINPACVAC

SEQ ID NO: 6880 - protein, 12 aa, Artificial Sequence
  Synthetically generated peptide
CEYCINPACGGC

SEQ ID NO: 6881 - protein, 12 aa, Artificial Sequence
  Synthetically generated peptide
CEYCINPACGAC

SEQ ID NO: 6882 - protein, 12 aa, Artificial Sequence
  Synthetically generated peptide
CEYCINPTCTGC

SEQ ID NO: 6883 - protein, 12 aa, Artificial Sequence
  Synthetically generated peptide
CEYCINPTCTAC

SEQ ID NO: 6884 - protein, 12 aa, Artificial Sequence
  Synthetically generated peptide
CEYCINPTCVGC

SEQ ID NO: 6885 - protein, 12 aa, Artificial Sequence
  Synthetically generated peptide
CEYCINPTCVAC

SEQ ID NO: 6886 - protein, 12 aa, Artificial Sequence
  Synthetically generated peptide
CEYCINPTCGGC

SEQ ID NO: 6887 - protein, 12 aa, Artificial Sequence
  Synthetically generated peptide
CEYCINPTCGAC

SEQ ID NO: 6888 - protein, 12 aa, Artificial Sequence
  Synthetically generated peptide
CEYCINGACTGC

SEQ ID NO: 6889 - protein, 12 aa, Artificial Sequence
  Synthetically generated peptide
CEYCINGACTAC

SEQ ID NO: 6890 - protein, 12 aa, Artificial Sequence
  Synthetically generated peptide
CEYCINGACVGC

SEQ ID NO: 6891 - protein, 12 aa, Artificial Sequence
  Synthetically generated peptide
CEYCINGACVAC

SEQ ID NO: 6892 - protein, 12 aa, Artificial Sequence
  Synthetically generated peptide
CEYCINGACGGC

SEQ ID NO: 6893 - protein, 12 aa, Artificial Sequence
  Synthetically generated peptide
CEYCINGACGAC

SEQ ID NO: 6894 - protein, 12 aa, Artificial Sequence
  Synthetically generated peptide
CEYCINGTCTGC

SEQ ID NO: 6895 - protein, 12 aa, Artificial Sequence
  Synthetically generated peptide
CEYCINGTCTAC

SEQ ID NO: 6896 - protein, 12 aa, Artificial Sequence
  Synthetically generated peptide
CEYCINGTCVGC

SEQ ID NO: 6897 - protein, 12 aa, Artificial Sequence
  Synthetically generated peptide
CEYCINGTCVAC

SEQ ID NO: 6898 - protein, 12 aa, Artificial Sequence
  Synthetically generated peptide
CEYCINGTCGGC

SEQ ID NO: 6899 - protein, 12 aa, Artificial Sequence
  Synthetically generated peptide
CEYCINGTCGAC

SEQ ID NO: 6900 - protein, 12 aa, Artificial Sequence
  Synthetically generated peptide
CEYCLNPACTGC

SEQ ID NO: 6901 - protein, 12 aa, Artificial Sequence
  Synthetically generated peptide
CEYCLNPACTAC

SEQ ID NO: 6902 - protein, 12 aa, Artificial Sequence
  Synthetically generated peptide
CEYCLNPACVGC

SEQ ID NO: 6903 - protein, 12 aa, Artificial Sequence
  Synthetically generated peptide
CEYCLNPACVAC

SEQ ID NO: 6904 - protein, 12 aa, Artificial Sequence
  Synthetically generated peptide
CEYCLNPACGGC

SEQ ID NO: 6905 - protein, 12 aa, Artificial Sequence
  Synthetically generated peptide
CEYCLNPACGAC

SEQ ID NO: 6906 - protein, 12 aa, Artificial Sequence
  Synthetically generated peptide
CEYCLNPTCTGC

SEQ ID NO: 6907 - protein, 12 aa, Artificial Sequence
  Synthetically generated peptide
CEYCLNPTCTAC

SEQ ID NO: 6908 - protein, 12 aa, Artificial Sequence
  Synthetically generated peptide
CEYCLNPTCVGC

SEQ ID NO: 6909 - protein, 12 aa, Artificial Sequence
  Synthetically generated peptide
CEYCLNPTCVAC

SEQ ID NO: 6910 - protein, 12 aa, Artificial Sequence
  Synthetically generated peptide
CEYCLNPTCGGC

SEQ ID NO: 6911 - protein, 12 aa, Artificial Sequence
  Synthetically generated peptide
CEYCLNPTCGAC

SEQ ID NO: 6912 - protein, 12 aa, Artificial Sequence
  Synthetically generated peptide
CEYCLNGACTGC

SEQ ID NO: 6913 - protein, 12 aa, Artificial Sequence
  Synthetically generated peptide
CEYCLNGACTAC

SEQ ID NO: 6914 - protein, 12 aa, Artificial Sequence
  Synthetically generated peptide
CEYCLNGACVGC

SEQ ID NO: 6915 - protein, 12 aa, Artificial Sequence
  Synthetically generated peptide
CEYCLNGACVAC

SEQ ID NO: 6916 - protein, 12 aa, Artificial Sequence
  Synthetically generated peptide
CEYCLNGACGGC

SEQ ID NO: 6917 - protein, 12 aa, Artificial Sequence
  Synthetically generated peptide
CEYCLNGACGAC

SEQ ID NO: 6918 - protein, 12 aa, Artificial Sequence
  Synthetically generated peptide
CEYCLNGTCTGC

SEQ ID NO: 6919 - protein, 12 aa, Artificial Sequence
  Synthetically generated peptide
CEYCLNGTCTAC

SEQ ID NO: 6920 - protein, 12 aa, Artificial Sequence
  Synthetically generated peptide
CEYCLNGTCVGC

SEQ ID NO: 6921 - protein, 12 aa, Artificial Sequence
  Synthetically generated peptide
CEYCLNGTCVAC

SEQ ID NO: 6922 - protein, 12 aa, Artificial Sequence
  Synthetically generated peptide
CEYCLNGTCGGC

SEQ ID NO: 6923 - protein, 12 aa, Artificial Sequence
  Synthetically generated peptide
CEYCLNGTCGAC

SEQ ID NO: 6924 - protein, 12 aa, Artificial Sequence
  Synthetically generated peptide
CEYCKNPACTGC

SEQ ID NO: 6925 - protein, 12 aa, Artificial Sequence
  Synthetically generated peptide
CEYCKNPACTAC

SEQ ID NO: 6926 - protein, 12 aa, Artificial Sequence
  Synthetically generated peptide
CEYCKNPACVGC

SEQ ID NO: 6927 - protein, 12 aa, Artificial Sequence
  Synthetically generated peptide
CEYCKNPACVAC

SEQ ID NO: 6928 - protein, 12 aa, Artificial Sequence
  Synthetically generated peptide
CEYCKNPACGGC

SEQ ID NO: 6929 - protein, 12 aa, Artificial Sequence
  Synthetically generated peptide
CEYCKNPACGAC

SEQ ID NO: 6930 - protein, 12 aa, Artificial Sequence
  Synthetically generated peptide
CEYCKNPTCTGC

SEQ ID NO: 6931 - protein, 12 aa, Artificial Sequence
  Synthetically generated peptide
CEYCKNPTCTAC

SEQ ID NO: 6932 - protein, 12 aa, Artificial Sequence
  Synthetically generated peptide
CEYCKNPTCVGC

SEQ ID NO: 6933 - protein, 12 aa, Artificial Sequence
  Synthetically generated peptide
CEYCKNPTCVAC

SEQ ID NO: 6934 - protein, 12 aa, Artificial Sequence
  Synthetically generated peptide
CEYCKNPTCGGC

SEQ ID NO: 6935 - protein, 12 aa, Artificial Sequence
  Synthetically generated peptide
CEYCKNPTCGAC

SEQ ID NO: 6936 - protein, 12 aa, Artificial Sequence
  Synthetically generated peptide
CEYCKNGACTGC

SEQ ID NO: 6937 - protein, 12 aa, Artificial Sequence
  Synthetically generated peptide
CEYCKNGACTAC

SEQ ID NO: 6938 - protein, 12 aa, Artificial Sequence
  Synthetically generated peptide
CEYCKNGACVGC

SEQ ID NO: 6939 - protein, 12 aa, Artificial Sequence
  Synthetically generated peptide
CEYCKNGACVAC

SEQ ID NO: 6940 - protein, 12 aa, Artificial Sequence
  Synthetically generated peptide
CEYCKNGACGGC

SEQ ID NO: 6941 - protein, 12 aa, Artificial Sequence
  Synthetically generated peptide
CEYCKNGACGAC

SEQ ID NO: 6942 - protein, 12 aa, Artificial Sequence
  Synthetically generated peptide
CEYCKNGTCTGC

SEQ ID NO: 6943 - protein, 12 aa, Artificial Sequence
  Synthetically generated peptide
CEYCKNGTCTAC

SEQ ID NO: 6944 - protein, 12 aa, Artificial Sequence
  Synthetically generated peptide
CEYCKNGTCVGC

SEQ ID NO: 6945 - protein, 12 aa, Artificial Sequence
  Synthetically generated peptide
CEYCKNGTCVAC

SEQ ID NO: 6946 - protein, 12 aa, Artificial Sequence
  Synthetically generated peptide
CEYCKNGTCGGC

SEQ ID NO: 6947 - protein, 12 aa, Artificial Sequence
  Synthetically generated peptide
CEYCKNGTCGAC

SEQ ID NO: 6948 - protein, 12 aa, Artificial Sequence
  Synthetically generated peptide
CEYCMNPACTGC

SEQ ID NO: 6949 - protein, 12 aa, Artificial Sequence
  Synthetically generated peptide
CEYCMNPACTAC

SEQ ID NO: 6950 - protein, 12 aa, Artificial Sequence
  Synthetically generated peptide
CEYCMNPACVGC

SEQ ID NO: 6951 - protein, 12 aa, Artificial Sequence
  Synthetically generated peptide
CEYCMNPACVAC

SEQ ID NO: 6952 - protein, 12 aa, Artificial Sequence
  Synthetically generated peptide
CEYCMNPACGGC

SEQ ID NO: 6953 - protein, 12 aa, Artificial Sequence
  Synthetically generated peptide
CEYCMNPACGAC

SEQ ID NO: 6954 - protein, 12 aa, Artificial Sequence
  Synthetically generated peptide
CEYCMNPTCTGC

SEQ ID NO: 6955 - protein, 12 aa, Artificial Sequence
  Synthetically generated peptide
CEYCMNPTCTAC

SEQ ID NO: 6956 - protein, 12 aa, Artificial Sequence
  Synthetically generated peptide
CEYCMNPTCVGC

SEQ ID NO: 6957 - protein, 12 aa, Artificial Sequence
  Synthetically generated peptide
CEYCMNPTCVAC

SEQ ID NO: 6958 - protein, 12 aa, Artificial Sequence
  Synthetically generated peptide
CEYCMNPTCGGC

SEQ ID NO: 6959 - protein, 12 aa, Artificial Sequence
  Synthetically generated peptide
CEYCMNPTCGAC

SEQ ID NO: 6960 - protein, 12 aa, Artificial Sequence
  Synthetically generated peptide
CEYCMNGACTGC

SEQ ID NO: 6961 - protein, 12 aa, Artificial Sequence
  Synthetically generated peptide
CEYCMNGACTAC

SEQ ID NO: 6962 - protein, 12 aa, Artificial Sequence
  Synthetically generated peptide
CEYCMNGACVGC

SEQ ID NO: 6963 - protein, 12 aa, Artificial Sequence
  Synthetically generated peptide
CEYCMNGACVAC

SEQ ID NO: 6964 - protein, 12 aa, Artificial Sequence
  Synthetically generated peptide
CEYCMNGACGGC

SEQ ID NO: 6965 - protein, 12 aa, Artificial Sequence
  Synthetically generated peptide
CEYCMNGACGAC

SEQ ID NO: 6966 - protein, 12 aa, Artificial Sequence
  Synthetically generated peptide
CEYCMNGTCTGC

SEQ ID NO: 6967 - protein, 12 aa, Artificial Sequence
  Synthetically generated peptide
CEYCMNGTCTAC

SEQ ID NO: 6968 - protein, 12 aa, Artificial Sequence
  Synthetically generated peptide
CEYCMNGTCVGC

SEQ ID NO: 6969 - protein, 12 aa, Artificial Sequence
  Synthetically generated peptide
CEYCMNGTCVAC

SEQ ID NO: 6970 - protein, 12 aa, Artificial Sequence
  Synthetically generated peptide
CEYCMNGTCGGC

SEQ ID NO: 6971 - protein, 12 aa, Artificial Sequence
  Synthetically generated peptide
CEYCMNGTCGAC

SEQ ID NO: 6972 - protein, 12 aa, Artificial Sequence
  Synthetically generated peptide
CEYCFNPACTGC

SEQ ID NO: 6973 - protein, 12 aa, Artificial Sequence
  Synthetically generated peptide
CEYCFNPACTAC

SEQ ID NO: 6974 - protein, 12 aa, Artificial Sequence
  Synthetically generated peptide
CEYCFNPACVGC

SEQ ID NO: 6975 - protein, 12 aa, Artificial Sequence
  Synthetically generated peptide
CEYCFNPACVAC

SEQ ID NO: 6976 - protein, 12 aa, Artificial Sequence
  Synthetically generated peptide
CEYCFNPACGGC

SEQ ID NO: 6977 - protein, 12 aa, Artificial Sequence
  Synthetically generated peptide
CEYCFNPACGAC

SEQ ID NO: 6978 - protein, 12 aa, Artificial Sequence
  Synthetically generated peptide
CEYCFNPTCTGC

SEQ ID NO: 6979 - protein, 12 aa, Artificial Sequence
  Synthetically generated peptide
CEYCFNPTCTAC

SEQ ID NO: 6980 - protein, 12 aa, Artificial Sequence
  Synthetically generated peptide
CEYCFNPTCVGC

SEQ ID NO: 6981 - protein, 12 aa, Artificial Sequence
  Synthetically generated peptide
CEYCFNPTCVAC

SEQ ID NO: 6982 - protein, 12 aa, Artificial Sequence
  Synthetically generated peptide
CEYCFNPTCGGC

SEQ ID NO: 6983 - protein, 12 aa, Artificial Sequence
  Synthetically generated peptide
CEYCFNPTCGAC

SEQ ID NO: 6984 - protein, 12 aa, Artificial Sequence
  Synthetically generated peptide
CEYCFNGACTGC

SEQ ID NO: 6985 - protein, 12 aa, Artificial Sequence
  Synthetically generated peptide
CEYCFNGACTAC

SEQ ID NO: 6986 - protein, 12 aa, Artificial Sequence
  Synthetically generated peptide
CEYCFNGACVGC

SEQ ID NO: 6987 - protein, 12 aa, Artificial Sequence
  Synthetically generated peptide
CEYCFNGACVAC

SEQ ID NO: 6988 - protein, 12 aa, Artificial Sequence
  Synthetically generated peptide
CEYCFNGACGGC

SEQ ID NO: 6989 - protein, 12 aa, Artificial Sequence
  Synthetically generated peptide
CEYCFNGACGAC

SEQ ID NO: 6990 - protein, 12 aa, Artificial Sequence
  Synthetically generated peptide
CEYCFNGTCTGC

SEQ ID NO: 6991 - protein, 12 aa, Artificial Sequence
  Synthetically generated peptide
CEYCFNGTCTAC

SEQ ID NO: 6992 - protein, 12 aa, Artificial Sequence
  Synthetically generated peptide
CEYCFNGTCVGC

SEQ ID NO: 6993 - protein, 12 aa, Artificial Sequence
  Synthetically generated peptide
CEYCFNGTCVAC

SEQ ID NO: 6994 - protein, 12 aa, Artificial Sequence
  Synthetically generated peptide
CEYCFNGTCGGC

SEQ ID NO: 6995 - protein, 12 aa, Artificial Sequence
  Synthetically generated peptide
CEYCFNGTCGAC

SEQ ID NO: 6996 - protein, 12 aa, Artificial Sequence
  Synthetically generated peptide
CEYCPNPACTGC

SEQ ID NO: 6997 - protein, 12 aa, Artificial Sequence
  Synthetically generated peptide
CEYCPNPACTAC

SEQ ID NO: 6998 - protein, 12 aa, Artificial Sequence
  Synthetically generated peptide
CEYCPNPACVGC

SEQ ID NO: 6999 - protein, 12 aa, Artificial Sequence
  Synthetically generated peptide
CEYCPNPACVAC

SEQ ID NO: 7000 - protein, 12 aa, Artificial Sequence
  Synthetically generated peptide
CEYCPNPACGGC

SEQ ID NO: 7001 - protein, 12 aa, Artificial Sequence
  Synthetically generated peptide
CEYCPNPACGAC

SEQ ID NO: 7002 - protein, 12 aa, Artificial Sequence
  Synthetically generated peptide
CEYCPNPTCTGC

SEQ ID NO: 7003 - protein, 12 aa, Artificial Sequence
  Synthetically generated peptide
CEYCPNPTCTAC

SEQ ID NO: 7004 - protein, 12 aa, Artificial Sequence
  Synthetically generated peptide
CEYCPNPTCVGC

SEQ ID NO: 7005 - protein, 12 aa, Artificial Sequence
  Synthetically generated peptide
CEYCPNPTCVAC

SEQ ID NO: 7006 - protein, 12 aa, Artificial Sequence
  Synthetically generated peptide
CEYCPNPTCGGC

SEQ ID NO: 7007 - protein, 12 aa, Artificial Sequence
  Synthetically generated peptide
CEYCPNPTCGAC

SEQ ID NO: 7008 - protein, 12 aa, Artificial Sequence
  Synthetically generated peptide
CEYCPNGACTGC

SEQ ID NO: 7009 - protein, 12 aa, Artificial Sequence
  Synthetically generated peptide
CEYCPNGACTAC

SEQ ID NO: 7010 - protein, 12 aa, Artificial Sequence
  Synthetically generated peptide
CEYCPNGACVGC

SEQ ID NO: 7011 - protein, 12 aa, Artificial Sequence
  Synthetically generated peptide
CEYCPNGACVAC

SEQ ID NO: 7012 - protein, 12 aa, Artificial Sequence
  Synthetically generated peptide
CEYCPNGACGGC

SEQ ID NO: 7013 - protein, 12 aa, Artificial Sequence
  Synthetically generated peptide
CEYCPNGACGAC

SEQ ID NO: 7014 - protein, 12 aa, Artificial Sequence
  Synthetically generated peptide
CEYCPNGTCTGC

SEQ ID NO: 7015 - protein, 12 aa, Artificial Sequence
  Synthetically generated peptide
CEYCPNGTCTAC

SEQ ID NO: 7016 - protein, 12 aa, Artificial Sequence
  Synthetically generated peptide
CEYCPNGTCVGC

SEQ ID NO: 7017 - protein, 12 aa, Artificial Sequence
  Synthetically generated peptide
CEYCPNGTCVAC

SEQ ID NO: 7018 - protein, 12 aa, Artificial Sequence
  Synthetically generated peptide
CEYCPNGTCGGC

SEQ ID NO: 7019 - protein, 12 aa, Artificial Sequence
  Synthetically generated peptide
CEYCPNGTCGAC

SEQ ID NO: 7020 - protein, 12 aa, Artificial Sequence
  Synthetically generated peptide
CEYCSNPACTGC

SEQ ID NO: 7021 - protein, 12 aa, Artificial Sequence
  Synthetically generated peptide
CEYCSNPACTAC

SEQ ID NO: 7022 - protein, 12 aa, Artificial Sequence
  Synthetically generated peptide
CEYCSNPACVGC

SEQ ID NO: 7023 - protein, 12 aa, Artificial Sequence
  Synthetically generated peptide
CEYCSNPACVAC

SEQ ID NO: 7024 - protein, 12 aa, Artificial Sequence
  Synthetically generated peptide
CEYCSNPACGGC

SEQ ID NO: 7025 - protein, 12 aa, Artificial Sequence
  Synthetically generated peptide
CEYCSNPACGAC

SEQ ID NO: 7026 - protein, 12 aa, Artificial Sequence
  Synthetically generated peptide
CEYCSNPTCTGC

SEQ ID NO: 7027 - protein, 12 aa, Artificial Sequence
  Synthetically generated peptide
CEYCSNPTCTAC

SEQ ID NO: 7028 - protein, 12 aa, Artificial Sequence
  Synthetically generated peptide
CEYCSNPTCVGC

SEQ ID NO: 7029 - protein, 12 aa, Artificial Sequence
  Synthetically generated peptide
CEYCSNPTCVAC

SEQ ID NO: 7030 - protein, 12 aa, Artificial Sequence
  Synthetically generated peptide
CEYCSNPTCGGC

SEQ ID NO: 7031 - protein, 12 aa, Artificial Sequence
  Synthetically generated peptide
CEYCSNPTCGAC

SEQ ID NO: 7032 - protein, 12 aa, Artificial Sequence
  Synthetically generated peptide
CEYCSNGACTGC

SEQ ID NO: 7033 - protein, 12 aa, Artificial Sequence
  Synthetically generated peptide
CEYCSNGACTAC

SEQ ID NO: 7034 - protein, 12 aa, Artificial Sequence
  Synthetically generated peptide
CEYCSNGACVGC

SEQ ID NO: 7035 - protein, 12 aa, Artificial Sequence
  Synthetically generated peptide
CEYCSNGACVAC

SEQ ID NO: 7036 - protein, 12 aa, Artificial Sequence
  Synthetically generated peptide
CEYCSNGACGGC

SEQ ID NO: 7037 - protein, 12 aa, Artificial Sequence
  Synthetically generated peptide
CEYCSNGACGAC

SEQ ID NO: 7038 - protein, 12 aa, Artificial Sequence
  Synthetically generated peptide
CEYCSNGTCTGC

SEQ ID NO: 7039 - protein, 12 aa, Artificial Sequence
  Synthetically generated peptide
CEYCSNGTCTAC

SEQ ID NO: 7040 - protein, 12 aa, Artificial Sequence
  Synthetically generated peptide
CEYCSNGTCVGC

SEQ ID NO: 7041 - protein, 12 aa, Artificial Sequence
  Synthetically generated peptide
CEYCSNGTCVAC

SEQ ID NO: 7042 - protein, 12 aa, Artificial Sequence
  Synthetically generated peptide
CEYCSNGTCGGC

SEQ ID NO: 7043 - protein, 12 aa, Artificial Sequence
  Synthetically generated peptide
CEYCSNGTCGAC

SEQ ID NO: 7044 - protein, 12 aa, Artificial Sequence
  Synthetically generated peptide
CEYCTNPACTGC

SEQ ID NO: 7045 - protein, 12 aa, Artificial Sequence
  Synthetically generated peptide
CEYCTNPACTAC

SEQ ID NO: 7046 - protein, 12 aa, Artificial Sequence
  Synthetically generated peptide
CEYCTNPACVGC

SEQ ID NO: 7047 - protein, 12 aa, Artificial Sequence
  Synthetically generated peptide
CEYCTNPACVAC

SEQ ID NO: 7048 - protein, 12 aa, Artificial Sequence
  Synthetically generated peptide
CEYCTNPACGGC

SEQ ID NO: 7049 - protein, 12 aa, Artificial Sequence
  Synthetically generated peptide
CEYCTNPACGAC

SEQ ID NO: 7050 - protein, 12 aa, Artificial Sequence
  Synthetically generated peptide
CEYCTNPTCTGC

SEQ ID NO: 7051 - protein, 12 aa, Artificial Sequence
  Synthetically generated peptide
CEYCTNPTCTAC

SEQ ID NO: 7052 - protein, 12 aa, Artificial Sequence
  Synthetically generated peptide
CEYCTNPTCVGC

SEQ ID NO: 7053 - protein, 12 aa, Artificial Sequence
  Synthetically generated peptide
CEYCTNPTCVAC

SEQ ID NO: 7054 - protein, 12 aa, Artificial Sequence
  Synthetically generated peptide
CEYCTNPTCGGC

SEQ ID NO: 7055 - protein, 12 aa, Artificial Sequence
  Synthetically generated peptide
CEYCTNPTCGAC

SEQ ID NO: 7056 - protein, 12 aa, Artificial Sequence
  Synthetically generated peptide
CEYCTNGACTGC

SEQ ID NO: 7057 - protein, 12 aa, Artificial Sequence
  Synthetically generated peptide
CEYCTNGACTAC

SEQ ID NO: 7058 - protein, 12 aa, Artificial Sequence
  Synthetically generated peptide
CEYCTNGACVGC

SEQ ID NO: 7059 - protein, 12 aa, Artificial Sequence
  Synthetically generated peptide
CEYCTNGACVAC

SEQ ID NO: 7060 - protein, 12 aa, Artificial Sequence
  Synthetically generated peptide
CEYCTNGACGGC

SEQ ID NO: 7061 - protein, 12 aa, Artificial Sequence
  Synthetically generated peptide
CEYCTNGACGAC

SEQ ID NO: 7062 - protein, 12 aa, Artificial Sequence
  Synthetically generated peptide
CEYCTNGTCTGC

SEQ ID NO: 7063 - protein, 12 aa, Artificial Sequence
  Synthetically generated peptide
CEYCTNGTCTAC

SEQ ID NO: 7064 - protein, 12 aa, Artificial Sequence
  Synthetically generated peptide
CEYCTNGTCVGC

SEQ ID NO: 7065 - protein, 12 aa, Artificial Sequence
  Synthetically generated peptide
CEYCTNGTCVAC

SEQ ID NO: 7066 - protein, 12 aa, Artificial Sequence
  Synthetically generated peptide
CEYCTNGTCGGC

SEQ ID NO: 7067 - protein, 12 aa, Artificial Sequence
  Synthetically generated peptide
CEYCTNGTCGAC

SEQ ID NO: 7068 - protein, 12 aa, Artificial Sequence
  Synthetically generated peptide
CEYCWNPACTGC

SEQ ID NO: 7069 - protein, 12 aa, Artificial Sequence
  Synthetically generated peptide
CEYCWNPACTAC

SEQ ID NO: 7070 - protein, 12 aa, Artificial Sequence
  Synthetically generated peptide
CEYCWNPACVGC

SEQ ID NO: 7071 - protein, 12 aa, Artificial Sequence
  Synthetically generated peptide
CEYCWNPACVAC

SEQ ID NO: 7072 - protein, 12 aa, Artificial Sequence
  Synthetically generated peptide
CEYCWNPACGGC

SEQ ID NO: 7073 - protein, 12 aa, Artificial Sequence
  Synthetically generated peptide
CEYCWNPACGAC

SEQ ID NO: 7074 - protein, 12 aa, Artificial Sequence
  Synthetically generated peptide
CEYCWNPTCTGC

SEQ ID NO: 7075 - protein, 12 aa, Artificial Sequence
  Synthetically generated peptide
CEYCWNPTCTAC

SEQ ID NO: 7076 - protein, 12 aa, Artificial Sequence
  Synthetically generated peptide
CEYCWNPTCVGC

SEQ ID NO: 7077 - protein, 12 aa, Artificial Sequence
  Synthetically generated peptide
CEYCWNPTCVAC

SEQ ID NO: 7078 - protein, 12 aa, Artificial Sequence
  Synthetically generated peptide
CEYCWNPTCGGC

SEQ ID NO: 7079 - protein, 12 aa, Artificial Sequence
  Synthetically generated peptide
CEYCWNPTCGAC

SEQ ID NO: 7080 - protein, 12 aa, Artificial Sequence
  Synthetically generated peptide
CEYCWNGACTGC

SEQ ID NO: 7081 - protein, 12 aa, Artificial Sequence
  Synthetically generated peptide
CEYCWNGACTAC

SEQ ID NO: 7082 - protein, 12 aa, Artificial Sequence
  Synthetically generated peptide
CEYCWNGACVGC

SEQ ID NO: 7083 - protein, 12 aa, Artificial Sequence
  Synthetically generated peptide
CEYCWNGACVAC

SEQ ID NO: 7084 - protein, 12 aa, Artificial Sequence
  Synthetically generated peptide
CEYCWNGACGGC

SEQ ID NO: 7085 - protein, 12 aa, Artificial Sequence
  Synthetically generated peptide
CEYCWNGACGAC

SEQ ID NO: 7086 - protein, 12 aa, Artificial Sequence
  Synthetically generated peptide
CEYCWNGTCTGC

SEQ ID NO: 7087 - protein, 12 aa, Artificial Sequence
  Synthetically generated peptide
CEYCWNGTCTAC

SEQ ID NO: 7088 - protein, 12 aa, Artificial Sequence
  Synthetically generated peptide
CEYCWNGTCVGC

SEQ ID NO: 7089 - protein, 12 aa, Artificial Sequence
  Synthetically generated peptide
CEYCWNGTCVAC

SEQ ID NO: 7090 - protein, 12 aa, Artificial Sequence
  Synthetically generated peptide
CEYCWNGTCGGC

SEQ ID NO: 7091 - protein, 12 aa, Artificial Sequence
  Synthetically generated peptide
CEYCWNGTCGAC

SEQ ID NO: 7092 - protein, 12 aa, Artificial Sequence
  Synthetically generated peptide
CEYCYNPACTGC

SEQ ID NO: 7093 - protein, 12 aa, Artificial Sequence
  Synthetically generated peptide
CEYCYNPACTAC

SEQ ID NO: 7094 - protein, 12 aa, Artificial Sequence
  Synthetically generated peptide
CEYCYNPACVGC

SEQ ID NO: 7095 - protein, 12 aa, Artificial Sequence
  Synthetically generated peptide
CEYCYNPACVAC

SEQ ID NO: 7096 - protein, 12 aa, Artificial Sequence
  Synthetically generated peptide
CEYCYNPACGGC

SEQ ID NO: 7097 - protein, 12 aa, Artificial Sequence
  Synthetically generated peptide
CEYCYNPACGAC

SEQ ID NO: 7098 - protein, 12 aa, Artificial Sequence
  Synthetically generated peptide
CEYCYNPTCTGC

SEQ ID NO: 7099 - protein, 12 aa, Artificial Sequence
  Synthetically generated peptide
CEYCYNPTCTAC

SEQ ID NO: 7100 - protein, 12 aa, Artificial Sequence
  Synthetically generated peptide
CEYCYNPTCVGC

SEQ ID NO: 7101 - protein, 12 aa, Artificial Sequence
  Synthetically generated peptide
CEYCYNPTCVAC

SEQ ID NO: 7102 - protein, 12 aa, Artificial Sequence
  Synthetically generated peptide
CEYCYNPTCGGC

SEQ ID NO: 7103 - protein, 12 aa, Artificial Sequence
  Synthetically generated peptide
CEYCYNPTCGAC

SEQ ID NO: 7104 - protein, 12 aa, Artificial Sequence
  Synthetically generated peptide
CEYCYNGACTGC

SEQ ID NO: 7105 - protein, 12 aa, Artificial Sequence
  Synthetically generated peptide
CEYCYNGACTAC

SEQ ID NO: 7106 - protein, 12 aa, Artificial Sequence
  Synthetically generated peptide
CEYCYNGACVGC

SEQ ID NO: 7107 - protein, 12 aa, Artificial Sequence
  Synthetically generated peptide
CEYCYNGACVAC

SEQ ID NO: 7108 - protein, 12 aa, Artificial Sequence
  Synthetically generated peptide
CEYCYNGACGGC

SEQ ID NO: 7109 - protein, 12 aa, Artificial Sequence
  Synthetically generated peptide
CEYCYNGACGAC

SEQ ID NO: 7110 - protein, 12 aa, Artificial Sequence
  Synthetically generated peptide
CEYCYNGTCTGC

SEQ ID NO: 7111 - protein, 12 aa, Artificial Sequence
  Synthetically generated peptide
CEYCYNGTCTAC

SEQ ID NO: 7112 - protein, 12 aa, Artificial Sequence
  Synthetically generated peptide
CEYCYNGTCVGC

SEQ ID NO: 7113 - protein, 12 aa, Artificial Sequence
  Synthetically generated peptide
CEYCYNGTCVAC

SEQ ID NO: 7114 - protein, 12 aa, Artificial Sequence
  Synthetically generated peptide
CEYCYNGTCGGC

SEQ ID NO: 7115 - protein, 12 aa, Artificial Sequence
  Synthetically generated peptide
CEYCYNGTCGAC

SEQ ID NO: 7116 - protein, 12 aa, Artificial Sequence
  Synthetically generated peptide
CEYCVNPACTGC

SEQ ID NO: 7117 - protein, 12 aa, Artificial Sequence
  Synthetically generated peptide
CEYCVNPACTAC

SEQ ID NO: 7118 - protein, 12 aa, Artificial Sequence
  Synthetically generated peptide
CEYCVNPACVGC

SEQ ID NO: 7119 - protein, 12 aa, Artificial Sequence
  Synthetically generated peptide
CEYCVNPACVAC

SEQ ID NO: 7120 - protein, 12 aa, Artificial Sequence
  Synthetically generated peptide
CEYCVNPACGGC

SEQ ID NO: 7121 - protein, 12 aa, Artificial Sequence
  Synthetically generated peptide
CEYCVNPACGAC

SEQ ID NO: 7122 - protein, 12 aa, Artificial Sequence
  Synthetically generated peptide
CEYCVNPTCTGC

SEQ ID NO: 7123 - protein, 12 aa, Artificial Sequence
  Synthetically generated peptide
CEYCVNPTCTAC

SEQ ID NO: 7124 - protein, 12 aa, Artificial Sequence
  Synthetically generated peptide
CEYCVNPTCVGC

SEQ ID NO: 7125 - protein, 12 aa, Artificial Sequence
  Synthetically generated peptide
CEYCVNPTCVAC

SEQ ID NO: 7126 - protein, 12 aa, Artificial Sequence
  Synthetically generated peptide
CEYCVNPTCGGC

SEQ ID NO: 7127 - protein, 12 aa, Artificial Sequence
  Synthetically generated peptide
CEYCVNPTCGAC

SEQ ID NO: 7128 - protein, 12 aa, Artificial Sequence
  Synthetically generated peptide
CEYCVNGACTGC

SEQ ID NO: 7129 - protein, 12 aa, Artificial Sequence
  Synthetically generated peptide
CEYCVNGACTAC

SEQ ID NO: 7130 - protein, 12 aa, Artificial Sequence
  Synthetically generated peptide
CEYCVNGACVGC

SEQ ID NO: 7131 - protein, 12 aa, Artificial Sequence
  Synthetically generated peptide
CEYCVNGACVAC

SEQ ID NO: 7132 - protein, 12 aa, Artificial Sequence
  Synthetically generated peptide
CEYCVNGACGGC

SEQ ID NO: 7133 - protein, 12 aa, Artificial Sequence
  Synthetically generated peptide
CEYCVNGACGAC

SEQ ID NO: 7134 - protein, 12 aa, Artificial Sequence
  Synthetically generated peptide
CEYCVNGTCTGC

SEQ ID NO: 7135 - protein, 12 aa, Artificial Sequence
  Synthetically generated peptide
CEYCVNGTCTAC

SEQ ID NO: 7136 - protein, 12 aa, Artificial Sequence
  Synthetically generated peptide
CEYCVNGTCVGC

SEQ ID NO: 7137 - protein, 12 aa, Artificial Sequence
  Synthetically generated peptide
CEYCVNGTCVAC

SEQ ID NO: 7138 - protein, 12 aa, Artificial Sequence
  Synthetically generated peptide
CEYCVNGTCGGC

SEQ ID NO: 7139 - protein, 12 aa, Artificial Sequence
  Synthetically generated peptide
CEYCVNGTCGAC

SEQ ID NO: 7140 - protein, 11 aa, Artificial Sequence
  Synthetically generated peptide
CEYCNPACTGC

SEQ ID NO: 7141 - protein, 11 aa, Artificial Sequence
  Synthetically generated peptide
CEYCNPACTAC

SEQ ID NO: 7142 - protein, 11 aa, Artificial Sequence
  Synthetically generated peptide
CEYCNPACVGC

SEQ ID NO: 7143 - protein, 11 aa, Artificial Sequence
  Synthetically generated peptide
CEYCNPACVAC

SEQ ID NO: 7144 - protein, 11 aa, Artificial Sequence
  Synthetically generated peptide
CEYCNPACGGC

SEQ ID NO: 7145 - protein, 11 aa, Artificial Sequence
  Synthetically generated peptide
CEYCNPACGAC

SEQ ID NO: 7146 - protein, 11 aa, Artificial Sequence
  Synthetically generated peptide
CEYCNPTCTGC

SEQ ID NO: 7147 - protein, 11 aa, Artificial Sequence
  Synthetically generated peptide
CEYCNPTCTAC

SEQ ID NO: 7148 - protein, 11 aa, Artificial Sequence
  Synthetically generated peptide
CEYCNPTCVGC

SEQ ID NO: 7149 - protein, 11 aa, Artificial Sequence
  Synthetically generated peptide
CEYCNPTCVAC

SEQ ID NO: 7150 - protein, 11 aa, Artificial Sequence
  Synthetically generated peptide
CEYCNPTCGGC

SEQ ID NO: 7151 - protein, 11 aa, Artificial Sequence
  Synthetically generated peptide
CEYCNPTCGAC

SEQ ID NO: 7152 - protein, 11 aa, Artificial Sequence
  Synthetically generated peptide
CEYCNGACTGC

SEQ ID NO: 7153 - protein, 11 aa, Artificial Sequence
  Synthetically generated peptide
CEYCNGACTAC

SEQ ID NO: 7154 - protein, 11 aa, Artificial Sequence
  Synthetically generated peptide
CEYCNGACVGC

SEQ ID NO: 7155 - protein, 11 aa, Artificial Sequence
  Synthetically generated peptide
CEYCNGACVAC

SEQ ID NO: 7156 - protein, 11 aa, Artificial Sequence
  Synthetically generated peptide
CEYCNGACGGC

SEQ ID NO: 7157 - protein, 11 aa, Artificial Sequence
  Synthetically generated peptide
CEYCNGACGAC

SEQ ID NO: 7158 - protein, 11 aa, Artificial Sequence
  Synthetically generated peptide
CEYCNGTCTGC

SEQ ID NO: 7159 - protein, 11 aa, Artificial Sequence
  Synthetically generated peptide
CEYCNGTCTAC

SEQ ID NO: 7160 - protein, 11 aa, Artificial Sequence
  Synthetically generated peptide
CEYCNGTCVGC

SEQ ID NO: 7161 - protein, 11 aa, Artificial Sequence
  Synthetically generated peptide
CEYCNGTCVAC

SEQ ID NO: 7162 - protein, 11 aa, Artificial Sequence
  Synthetically generated peptide
CEYCNGTCGGC

SEQ ID NO: 7163 - protein, 11 aa, Artificial Sequence
  Synthetically generated peptide
CEYCNGTCGAC

SEQ ID NO: 7164 - protein, 12 aa, Artificial Sequence
  Synthetically generated peptide
CEWCANPACTGC

SEQ ID NO: 7165 - protein, 12 aa, Artificial Sequence
  Synthetically generated peptide
CEWCANPACTAC

SEQ ID NO: 7166 - protein, 12 aa, Artificial Sequence
  Synthetically generated peptide
CEWCANPACVGC

SEQ ID NO: 7167 - protein, 12 aa, Artificial Sequence
  Synthetically generated peptide
CEWCANPACVAC

SEQ ID NO: 7168 - protein, 12 aa, Artificial Sequence
  Synthetically generated peptide
CEWCANPACGGC

SEQ ID NO: 7169 - protein, 12 aa, Artificial Sequence
  Synthetically generated peptide
CEWCANPACGAC

SEQ ID NO: 7170 - protein, 12 aa, Artificial Sequence
  Synthetically generated peptide
CEWCANPTCTGC

SEQ ID NO: 7171 - protein, 12 aa, Artificial Sequence
  Synthetically generated peptide
CEWCANPTCTAC

SEQ ID NO: 7172 - protein, 12 aa, Artificial Sequence
  Synthetically generated peptide
CEWCANPTCVGC

SEQ ID NO: 7173 - protein, 12 aa, Artificial Sequence
  Synthetically generated peptide
CEWCANPTCVAC

SEQ ID NO: 7174 - protein, 12 aa, Artificial Sequence
  Synthetically generated peptide
CEWCANPTCGGC

SEQ ID NO: 7175 - protein, 12 aa, Artificial Sequence
  Synthetically generated peptide
CEWCANPTCGAC

SEQ ID NO: 7176 - protein, 12 aa, Artificial Sequence
  Synthetically generated peptide
CEWCANGACTGC

SEQ ID NO: 7177 - protein, 12 aa, Artificial Sequence
  Synthetically generated peptide
CEWCANGACTAC

SEQ ID NO: 7178 - protein, 12 aa, Artificial Sequence
  Synthetically generated peptide
CEWCANGACVGC

SEQ ID NO: 7179 - protein, 12 aa, Artificial Sequence
  Synthetically generated peptide
CEWCANGACVAC

SEQ ID NO: 7180 - protein, 12 aa, Artificial Sequence
  Synthetically generated peptide
CEWCANGACGGC

SEQ ID NO: 7181 - protein, 12 aa, Artificial Sequence
  Synthetically generated peptide
CEWCANGACGAC

SEQ ID NO: 7182 - protein, 12 aa, Artificial Sequence
  Synthetically generated peptide
CEWCANGTCTGC

SEQ ID NO: 7183 - protein, 12 aa, Artificial Sequence
  Synthetically generated peptide
CEWCANGTCTAC

SEQ ID NO: 7184 - protein, 12 aa, Artificial Sequence
  Synthetically generated peptide
CEWCANGTCVGC

SEQ ID NO: 7185 - protein, 12 aa, Artificial Sequence
  Synthetically generated peptide
CEWCANGTCVAC

SEQ ID NO: 7186 - protein, 12 aa, Artificial Sequence
  Synthetically generated peptide
CEWCANGTCGGC

SEQ ID NO: 7187 - protein, 12 aa, Artificial Sequence
  Synthetically generated peptide
CEWCANGTCGAC

SEQ ID NO: 7188 - protein, 12 aa, Artificial Sequence
  Synthetically generated peptide
CEWCRNPACTGC

SEQ ID NO: 7189 - protein, 12 aa, Artificial Sequence
  Synthetically generated peptide
CEWCRNPACTAC

SEQ ID NO: 7190 - protein, 12 aa, Artificial Sequence
  Synthetically generated peptide
CEWCRNPACVGC

SEQ ID NO: 7191 - protein, 12 aa, Artificial Sequence
  Synthetically generated peptide
CEWCRNPACVAC

SEQ ID NO: 7192 - protein, 12 aa, Artificial Sequence
  Synthetically generated peptide
CEWCRNPACGGC

SEQ ID NO: 7193 - protein, 12 aa, Artificial Sequence
  Synthetically generated peptide
CEWCRNPACGAC

SEQ ID NO: 7194 - protein, 12 aa, Artificial Sequence
  Synthetically generated peptide
CEWCRNPTCTGC

SEQ ID NO: 7195 - protein, 12 aa, Artificial Sequence
  Synthetically generated peptide
CEWCRNPTCTAC

SEQ ID NO: 7196 - protein, 12 aa, Artificial Sequence
  Synthetically generated peptide
CEWCRNPTCVGC

SEQ ID NO: 7197 - protein, 12 aa, Artificial Sequence
  Synthetically generated peptide
CEWCRNPTCVAC

SEQ ID NO: 7198 - protein, 12 aa, Artificial Sequence
  Synthetically generated peptide
CEWCRNPTCGGC

SEQ ID NO: 7199 - protein, 12 aa, Artificial Sequence
  Synthetically generated peptide
CEWCRNPTCGAC

SEQ ID NO: 7200 - protein, 12 aa, Artificial Sequence
  Synthetically generated peptide
CEWCRNGACTGC

SEQ ID NO: 7201 - protein, 12 aa, Artificial Sequence
  Synthetically generated peptide
CEWCRNGACTAC

SEQ ID NO: 7202 - protein, 12 aa, Artificial Sequence
  Synthetically generated peptide
CEWCRNGACVGC

SEQ ID NO: 7203 - protein, 12 aa, Artificial Sequence
  Synthetically generated peptide
CEWCRNGACVAC

SEQ ID NO: 7204 - protein, 12 aa, Artificial Sequence
  Synthetically generated peptide
CEWCRNGACGGC

SEQ ID NO: 7205 - protein, 12 aa, Artificial Sequence
  Synthetically generated peptide
CEWCRNGACGAC

SEQ ID NO: 7206 - protein, 12 aa, Artificial Sequence
  Synthetically generated peptide
CEWCRNGTCTGC

SEQ ID NO: 7207 - protein, 12 aa, Artificial Sequence
  Synthetically generated peptide
CEWCRNGTCTAC

SEQ ID NO: 7208 - protein, 12 aa, Artificial Sequence
  Synthetically generated peptide
CEWCRNGTCVGC

SEQ ID NO: 7209 - protein, 12 aa, Artificial Sequence
  Synthetically generated peptide
CEWCRNGTCVAC

SEQ ID NO: 7210 - protein, 12 aa, Artificial Sequence
  Synthetically generated peptide
CEWCRNGTCGGC

SEQ ID NO: 7211 - protein, 12 aa, Artificial Sequence
  Synthetically generated peptide
CEWCRNGTCGAC

SEQ ID NO: 7212 - protein, 12 aa, Artificial Sequence
  Synthetically generated peptide
CEWCNNPACTGC

SEQ ID NO: 7213 - protein, 12 aa, Artificial Sequence
  Synthetically generated peptide
CEWCNNPACTAC

SEQ ID NO: 7214 - protein, 12 aa, Artificial Sequence
  Synthetically generated peptide
CEWCNNPACVGC

SEQ ID NO: 7215 - protein, 12 aa, Artificial Sequence
  Synthetically generated peptide
CEWCNNPACVAC

SEQ ID NO: 7216 - protein, 12 aa, Artificial Sequence
  Synthetically generated peptide
CEWCNNPACGGC

SEQ ID NO: 7217 - protein, 12 aa, Artificial Sequence
  Synthetically generated peptide
CEWCNNPACGAC

SEQ ID NO: 7218 - protein, 12 aa, Artificial Sequence
  Synthetically generated peptide
CEWCNNPTCTGC

SEQ ID NO: 7219 - protein, 12 aa, Artificial Sequence
  Synthetically generated peptide
CEWCNNPTCTAC

SEQ ID NO: 7220 - protein, 12 aa, Artificial Sequence
  Synthetically generated peptide
CEWCNNPTCVGC

SEQ ID NO: 7221 - protein, 12 aa, Artificial Sequence
  Synthetically generated peptide
CEWCNNPTCVAC

SEQ ID NO: 7222 - protein, 12 aa, Artificial Sequence
  Synthetically generated peptide
CEWCNNPTCGGC

SEQ ID NO: 7223 - protein, 12 aa, Artificial Sequence
  Synthetically generated peptide
CEWCNNPTCGAC

SEQ ID NO: 7224 - protein, 12 aa, Artificial Sequence
  Synthetically generated peptide
CEWCNNGACTGC

SEQ ID NO: 7225 - protein, 12 aa, Artificial Sequence
  Synthetically generated peptide
CEWCNNGACTAC

SEQ ID NO: 7226 - protein, 12 aa, Artificial Sequence
  Synthetically generated peptide
CEWCNNGACVGC

SEQ ID NO: 7227 - protein, 12 aa, Artificial Sequence
  Synthetically generated peptide
CEWCNNGACVAC

SEQ ID NO: 7228 - protein, 12 aa, Artificial Sequence
  Synthetically generated peptide
CEWCNNGACGGC

SEQ ID NO: 7229 - protein, 12 aa, Artificial Sequence
  Synthetically generated peptide
CEWCNNGACGAC

SEQ ID NO: 7230 - protein, 12 aa, Artificial Sequence
  Synthetically generated peptide
CEWCNNGTCTGC

SEQ ID NO: 7231 - protein, 12 aa, Artificial Sequence
  Synthetically generated peptide
CEWCNNGTCTAC

SEQ ID NO: 7232 - protein, 12 aa, Artificial Sequence
  Synthetically generated peptide
CEWCNNGTCVGC

SEQ ID NO: 7233 - protein, 12 aa, Artificial Sequence
  Synthetically generated peptide
CEWCNNGTCVAC

SEQ ID NO: 7234 - protein, 12 aa, Artificial Sequence
  Synthetically generated peptide
CEWCNNGTCGGC

SEQ ID NO: 7235 - protein, 12 aa, Artificial Sequence
  Synthetically generated peptide
CEWCNNGTCGAC

SEQ ID NO: 7236 - protein, 12 aa, Artificial Sequence
  Synthetically generated peptide
CEWCDNPACTGC

SEQ ID NO: 7237 - protein, 12 aa, Artificial Sequence
  Synthetically generated peptide
CEWCDNPACTAC

SEQ ID NO: 7238 - protein, 12 aa, Artificial Sequence
  Synthetically generated peptide
CEWCDNPACVGC

SEQ ID NO: 7239 - protein, 12 aa, Artificial Sequence
  Synthetically generated peptide
CEWCDNPACVAC

SEQ ID NO: 7240 - protein, 12 aa, Artificial Sequence
  Synthetically generated peptide
CEWCDNPACGGC

SEQ ID NO: 7241 - protein, 12 aa, Artificial Sequence
  Synthetically generated peptide
CEWCDNPACGAC

SEQ ID NO: 7242 - protein, 12 aa, Artificial Sequence
  Synthetically generated peptide
CEWCDNPTCTGC

SEQ ID NO: 7243 - protein, 12 aa, Artificial Sequence
  Synthetically generated peptide
CEWCDNPTCTAC

SEQ ID NO: 7244 - protein, 12 aa, Artificial Sequence
  Synthetically generated peptide
CEWCDNPTCVGC

SEQ ID NO: 7245 - protein, 12 aa, Artificial Sequence
  Synthetically generated peptide
CEWCDNPTCVAC

SEQ ID NO: 7246 - protein, 12 aa, Artificial Sequence
  Synthetically generated peptide
CEWCDNPTCGGC

SEQ ID NO: 7247 - protein, 12 aa, Artificial Sequence
  Synthetically generated peptide
CEWCDNPTCGAC

SEQ ID NO: 7248 - protein, 12 aa, Artificial Sequence
  Synthetically generated peptide
CEWCDNGACTGC

SEQ ID NO: 7249 - protein, 12 aa, Artificial Sequence
  Synthetically generated peptide
CEWCDNGACTAC

SEQ ID NO: 7250 - protein, 12 aa, Artificial Sequence
  Synthetically generated peptide
CEWCDNGACVGC

SEQ ID NO: 7251 - protein, 12 aa, Artificial Sequence
  Synthetically generated peptide
CEWCDNGACVAC

SEQ ID NO: 7252 - protein, 12 aa, Artificial Sequence
  Synthetically generated peptide
CEWCDNGACGGC

SEQ ID NO: 7253 - protein, 12 aa, Artificial Sequence
  Synthetically generated peptide
CEWCDNGACGAC

SEQ ID NO: 7254 - protein, 12 aa, Artificial Sequence
  Synthetically generated peptide
CEWCDNGTCTGC

SEQ ID NO: 7255 - protein, 12 aa, Artificial Sequence
  Synthetically generated peptide
CEWCDNGTCTAC

SEQ ID NO: 7256 - protein, 12 aa, Artificial Sequence
  Synthetically generated peptide
CEWCDNGTCVGC

SEQ ID NO: 7257 - protein, 12 aa, Artificial Sequence
  Synthetically generated peptide
CEWCDNGTCVAC

SEQ ID NO: 7258 - protein, 12 aa, Artificial Sequence
  Synthetically generated peptide
CEWCDNGTCGGC

SEQ ID NO: 7259 - protein, 12 aa, Artificial Sequence
  Synthetically generated peptide
CEWCDNGTCGAC

SEQ ID NO: 7260 - protein, 12 aa, Artificial Sequence
  Synthetically generated peptide
CEWCQNPACTGC

SEQ ID NO: 7261 - protein, 12 aa, Artificial Sequence
  Synthetically generated peptide
CEWCQNPACTAC

SEQ ID NO: 7262 - protein, 12 aa, Artificial Sequence
  Synthetically generated peptide
CEWCQNPACVGC

SEQ ID NO: 7263 - protein, 12 aa, Artificial Sequence
  Synthetically generated peptide
CEWCQNPACVAC

SEQ ID NO: 7264 - protein, 12 aa, Artificial Sequence
  Synthetically generated peptide
CEWCQNPACGGC

SEQ ID NO: 7265 - protein, 12 aa, Artificial Sequence
  Synthetically generated peptide
CEWCQNPACGAC

SEQ ID NO: 7266 - protein, 12 aa, Artificial Sequence
  Synthetically generated peptide
CEWCQNPTCTGC

SEQ ID NO: 7267 - protein, 12 aa, Artificial Sequence
  Synthetically generated peptide
CEWCQNPTCTAC

SEQ ID NO: 7268 - protein, 12 aa, Artificial Sequence
  Synthetically generated peptide
CEWCQNPTCVGC

SEQ ID NO: 7269 - protein, 12 aa, Artificial Sequence
  Synthetically generated peptide
CEWCQNPTCVAC

SEQ ID NO: 7270 - protein, 12 aa, Artificial Sequence
  Synthetically generated peptide
CEWCQNPTCGGC

SEQ ID NO: 7271 - protein, 12 aa, Artificial Sequence
  Synthetically generated peptide
CEWCQNPTCGAC

SEQ ID NO: 7272 - protein, 12 aa, Artificial Sequence
  Synthetically generated peptide
CEWCQNGACTGC

SEQ ID NO: 7273 - protein, 12 aa, Artificial Sequence
  Synthetically generated peptide
CEWCQNGACTAC

SEQ ID NO: 7274 - protein, 12 aa, Artificial Sequence
  Synthetically generated peptide
CEWCQNGACVGC

SEQ ID NO: 7275 - protein, 12 aa, Artificial Sequence
  Synthetically generated peptide
CEWCQNGACVAC

SEQ ID NO: 7276 - protein, 12 aa, Artificial Sequence
  Synthetically generated peptide
CEWCQNGACGGC

SEQ ID NO: 7277 - protein, 12 aa, Artificial Sequence
  Synthetically generated peptide
CEWCQNGACGAC

SEQ ID NO: 7278 - protein, 12 aa, Artificial Sequence
  Synthetically generated peptide
CEWCQNGTCTGC

SEQ ID NO: 7279 - protein, 12 aa, Artificial Sequence
  Synthetically generated peptide
CEWCQNGTCTAC

SEQ ID NO: 7280 - protein, 12 aa, Artificial Sequence
  Synthetically generated peptide
CEWCQNGTCVGC

SEQ ID NO: 7281 - protein, 12 aa, Artificial Sequence
  Synthetically generated peptide
CEWCQNGTCVAC

SEQ ID NO: 7282 - protein, 12 aa, Artificial Sequence
  Synthetically generated peptide
CEWCQNGTCGGC

SEQ ID NO: 7283 - protein, 12 aa, Artificial Sequence
  Synthetically generated peptide
CEWCQNGTCGAC

SEQ ID NO: 7284 - protein, 12 aa, Artificial Sequence
  Synthetically generated peptide
CEWCENPACTGC

SEQ ID NO: 7285 - protein, 12 aa, Artificial Sequence
  Synthetically generated peptide
CEWCENPACTAC

SEQ ID NO: 7286 - protein, 12 aa, Artificial Sequence
  Synthetically generated peptide
CEWCENPACVGC

SEQ ID NO: 7287 - protein, 12 aa, Artificial Sequence
  Synthetically generated peptide
CEWCENPACVAC

SEQ ID NO: 7288 - protein, 12 aa, Artificial Sequence
  Synthetically generated peptide
CEWCENPACGGC

SEQ ID NO: 7289 - protein, 12 aa, Artificial Sequence
  Synthetically generated peptide
CEWCENPACGAC

SEQ ID NO: 7290 - protein, 12 aa, Artificial Sequence
  Synthetically generated peptide
CEWCENPTCTGC

SEQ ID NO: 7291 - protein, 12 aa, Artificial Sequence
  Synthetically generated peptide
CEWCENPTCTAC

SEQ ID NO: 7292 - protein, 12 aa, Artificial Sequence
  Synthetically generated peptide
CEWCENPTCVGC

SEQ ID NO: 7293 - protein, 12 aa, Artificial Sequence
  Synthetically generated peptide
CEWCENPTCVAC

SEQ ID NO: 7294 - protein, 12 aa, Artificial Sequence
  Synthetically generated peptide
CEWCENPTCGGC

SEQ ID NO: 7295 - protein, 12 aa, Artificial Sequence
  Synthetically generated peptide
CEWCENPTCGAC

SEQ ID NO: 7296 - protein, 12 aa, Artificial Sequence
  Synthetically generated peptide
CEWCENGACTGC

SEQ ID NO: 7297 - protein, 12 aa, Artificial Sequence
  Synthetically generated peptide
CEWCENGACTAC

SEQ ID NO: 7298 - protein, 12 aa, Artificial Sequence
  Synthetically generated peptide
CEWCENGACVGC

SEQ ID NO: 7299 - protein, 12 aa, Artificial Sequence
  Synthetically generated peptide
CEWCENGACVAC

SEQ ID NO: 7300 - protein, 12 aa, Artificial Sequence
  Synthetically generated peptide
CEWCENGACGGC

SEQ ID NO: 7301 - protein, 12 aa, Artificial Sequence
  Synthetically generated peptide
CEWCENGACGAC

SEQ ID NO: 7302 - protein, 12 aa, Artificial Sequence
  Synthetically generated peptide
CEWCENGTCTGC

SEQ ID NO: 7303 - protein, 12 aa, Artificial Sequence
  Synthetically generated peptide
CEWCENGTCTAC

SEQ ID NO: 7304 - protein, 12 aa, Artificial Sequence
  Synthetically generated peptide
CEWCENGTCVGC

SEQ ID NO: 7305 - protein, 12 aa, Artificial Sequence
  Synthetically generated peptide
CEWCENGTCVAC

SEQ ID NO: 7306 - protein, 12 aa, Artificial Sequence
  Synthetically generated peptide
CEWCENGTCGGC

SEQ ID NO: 7307 - protein, 12 aa, Artificial Sequence
  Synthetically generated peptide
CEWCENGTCGAC

SEQ ID NO: 7308 - protein, 12 aa, Artificial Sequence
  Synthetically generated peptide
CEWCGNPACTGC

SEQ ID NO: 7309 - protein, 12 aa, Artificial Sequence
  Synthetically generated peptide
CEWCGNPACTAC

SEQ ID NO: 7310 - protein, 12 aa, Artificial Sequence
  Synthetically generated peptide
CEWCGNPACVGC

SEQ ID NO: 7311 - protein, 12 aa, Artificial Sequence
  Synthetically generated peptide
CEWCGNPACVAC

SEQ ID NO: 7312 - protein, 12 aa, Artificial Sequence
  Synthetically generated peptide
CEWCGNPACGGC

SEQ ID NO: 7313 - protein, 12 aa, Artificial Sequence
  Synthetically generated peptide
CEWCGNPACGAC

SEQ ID NO: 7314 - protein, 12 aa, Artificial Sequence
  Synthetically generated peptide
CEWCGNPTCTGC

SEQ ID NO: 7315 - protein, 12 aa, Artificial Sequence
  Synthetically generated peptide
CEWCGNPTCTAC

SEQ ID NO: 7316 - protein, 12 aa, Artificial Sequence
  Synthetically generated peptide
CEWCGNPTCVGC

SEQ ID NO: 7317 - protein, 12 aa, Artificial Sequence
  Synthetically generated peptide
CEWCGNPTCVAC

SEQ ID NO: 7318 - protein, 12 aa, Artificial Sequence
  Synthetically generated peptide
CEWCGNPTCGGC

SEQ ID NO: 7319 - protein, 12 aa, Artificial Sequence
  Synthetically generated peptide
CEWCGNPTCGAC

SEQ ID NO: 7320 - protein, 12 aa, Artificial Sequence
  Synthetically generated peptide
CEWCGNGACTGC

SEQ ID NO: 7321 - protein, 12 aa, Artificial Sequence
  Synthetically generated peptide
CEWCGNGACTAC

SEQ ID NO: 7322 - protein, 12 aa, Artificial Sequence
  Synthetically generated peptide
CEWCGNGACVGC

SEQ ID NO: 7323 - protein, 12 aa, Artificial Sequence
  Synthetically generated peptide
CEWCGNGACVAC

SEQ ID NO: 7324 - protein, 12 aa, Artificial Sequence
  Synthetically generated peptide
CEWCGNGACGGC

SEQ ID NO: 7325 - protein, 12 aa, Artificial Sequence
  Synthetically generated peptide
CEWCGNGACGAC

SEQ ID NO: 7326 - protein, 12 aa, Artificial Sequence
  Synthetically generated peptide
CEWCGNGTCTGC

SEQ ID NO: 7327 - protein, 12 aa, Artificial Sequence
  Synthetically generated peptide
CEWCGNGTCTAC

SEQ ID NO: 7328 - protein, 12 aa, Artificial Sequence
  Synthetically generated peptide
CEWCGNGTCVGC

SEQ ID NO: 7329 - protein, 12 aa, Artificial Sequence
  Synthetically generated peptide
CEWCGNGTCVAC

SEQ ID NO: 7330 - protein, 12 aa, Artificial Sequence
  Synthetically generated peptide
CEWCGNGTCGGC

SEQ ID NO: 7331 - protein, 12 aa, Artificial Sequence
  Synthetically generated peptide
CEWCGNGTCGAC

SEQ ID NO: 7332 - protein, 12 aa, Artificial Sequence
  Synthetically generated peptide
CEWCHNPACTGC

SEQ ID NO: 7333 - protein, 12 aa, Artificial Sequence
  Synthetically generated peptide
CEWCHNPACTAC

SEQ ID NO: 7334 - protein, 12 aa, Artificial Sequence
  Synthetically generated peptide
CEWCHNPACVGC

SEQ ID NO: 7335 - protein, 12 aa, Artificial Sequence
  Synthetically generated peptide
CEWCHNPACVAC

SEQ ID NO: 7336 - protein, 12 aa, Artificial Sequence
  Synthetically generated peptide
CEWCHNPACGGC

SEQ ID NO: 7337 - protein, 12 aa, Artificial Sequence
  Synthetically generated peptide
CEWCHNPACGAC

SEQ ID NO: 7338 - protein, 12 aa, Artificial Sequence
  Synthetically generated peptide
CEWCHNPTCTGC

SEQ ID NO: 7339 - protein, 12 aa, Artificial Sequence
  Synthetically generated peptide
CEWCHNPTCTAC

SEQ ID NO: 7340 - protein, 12 aa, Artificial Sequence
  Synthetically generated peptide
CEWCHNPTCVGC

SEQ ID NO: 7341 - protein, 12 aa, Artificial Sequence
  Synthetically generated peptide
CEWCHNPTCVAC

SEQ ID NO: 7342 - protein, 12 aa, Artificial Sequence
  Synthetically generated peptide
CEWCHNPTCGGC

SEQ ID NO: 7343 - protein, 12 aa, Artificial Sequence
  Synthetically generated peptide
CEWCHNPTCGAC

SEQ ID NO: 7344 - protein, 12 aa, Artificial Sequence
  Synthetically generated peptide
CEWCHNGACTGC

SEQ ID NO: 7345 - protein, 12 aa, Artificial Sequence
  Synthetically generated peptide
CEWCHNGACTAC

SEQ ID NO: 7346 - protein, 12 aa, Artificial Sequence
  Synthetically generated peptide
CEWCHNGACVGC

SEQ ID NO: 7347 - protein, 12 aa, Artificial Sequence
  Synthetically generated peptide
CEWCHNGACVAC

SEQ ID NO: 7348 - protein, 12 aa, Artificial Sequence
  Synthetically generated peptide
CEWCHNGACGGC

SEQ ID NO: 7349 - protein, 12 aa, Artificial Sequence
  Synthetically generated peptide
CEWCHNGACGAC

SEQ ID NO: 7350 - protein, 12 aa, Artificial Sequence
  Synthetically generated peptide
CEWCHNGTCTGC

SEQ ID NO: 7351 - protein, 12 aa, Artificial Sequence
  Synthetically generated peptide
CEWCHNGTCTAC

SEQ ID NO: 7352 - protein, 12 aa, Artificial Sequence
  Synthetically generated peptide
CEWCHNGTCVGC

SEQ ID NO: 7353 - protein, 12 aa, Artificial Sequence
  Synthetically generated peptide
CEWCHNGTCVAC

SEQ ID NO: 7354 - protein, 12 aa, Artificial Sequence
  Synthetically generated peptide
CEWCHNGTCGGC

SEQ ID NO: 7355 - protein, 12 aa, Artificial Sequence
  Synthetically generated peptide
CEWCHNGTCGAC

SEQ ID NO: 7356 - protein, 12 aa, Artificial Sequence
  Synthetically generated peptide
CEWCINPACTGC

SEQ ID NO: 7357 - protein, 12 aa, Artificial Sequence
  Synthetically generated peptide
CEWCINPACTAC

SEQ ID NO: 7358 - protein, 12 aa, Artificial Sequence
  Synthetically generated peptide
CEWCINPACVGC

SEQ ID NO: 7359 - protein, 12 aa, Artificial Sequence
  Synthetically generated peptide
CEWCINPACVAC

SEQ ID NO: 7360 - protein, 12 aa, Artificial Sequence
  Synthetically generated peptide
CEWCINPACGGC

SEQ ID NO: 7361 - protein, 12 aa, Artificial Sequence
  Synthetically generated peptide
CEWCINPACGAC

SEQ ID NO: 7362 - protein, 12 aa, Artificial Sequence
  Synthetically generated peptide
CEWCINPTCTGC

SEQ ID NO: 7363 - protein, 12 aa, Artificial Sequence
  Synthetically generated peptide
CEWCINPTCTAC

SEQ ID NO: 7364 - protein, 12 aa, Artificial Sequence
  Synthetically generated peptide
CEWCINPTCVGC

SEQ ID NO: 7365 - protein, 12 aa, Artificial Sequence
  Synthetically generated peptide
CEWCINPTCVAC

SEQ ID NO: 7366 - protein, 12 aa, Artificial Sequence
  Synthetically generated peptide
CEWCINPTCGGC

SEQ ID NO: 7367 - protein, 12 aa, Artificial Sequence
  Synthetically generated peptide
CEWCINPTCGAC

SEQ ID NO: 7368 - protein, 12 aa, Artificial Sequence
  Synthetically generated peptide
CEWCINGACTGC

SEQ ID NO: 7369 - protein, 12 aa, Artificial Sequence
  Synthetically generated peptide
CEWCINGACTAC

SEQ ID NO: 7370 - protein, 12 aa, Artificial Sequence
  Synthetically generated peptide
CEWCINGACVGC

SEQ ID NO: 7371 - protein, 12 aa, Artificial Sequence
  Synthetically generated peptide
CEWCINGACVAC

SEQ ID NO: 7372 - protein, 12 aa, Artificial Sequence
  Synthetically generated peptide
CEWCINGACGGC

SEQ ID NO: 7373 - protein, 12 aa, Artificial Sequence
  Synthetically generated peptide
CEWCINGACGAC

SEQ ID NO: 7374 - protein, 12 aa, Artificial Sequence
  Synthetically generated peptide
CEWCINGTCTGC

SEQ ID NO: 7375 - protein, 12 aa, Artificial Sequence
  Synthetically generated peptide
CEWCINGTCTAC

SEQ ID NO: 7376 - protein, 12 aa, Artificial Sequence
  Synthetically generated peptide
CEWCINGTCVGC

SEQ ID NO: 7377 - protein, 12 aa, Artificial Sequence
  Synthetically generated peptide
CEWCINGTCVAC

SEQ ID NO: 7378 - protein, 12 aa, Artificial Sequence
  Synthetically generated peptide
CEWCINGTCGGC

SEQ ID NO: 7379 - protein, 12 aa, Artificial Sequence
  Synthetically generated peptide
CEWCINGTCGAC

SEQ ID NO: 7380 - protein, 12 aa, Artificial Sequence
  Synthetically generated peptide
CEWCLNPACTGC

SEQ ID NO: 7381 - protein, 12 aa, Artificial Sequence
  Synthetically generated peptide
CEWCLNPACTAC

SEQ ID NO: 7382 - protein, 12 aa, Artificial Sequence
  Synthetically generated peptide
CEWCLNPACVGC

SEQ ID NO: 7383 - protein, 12 aa, Artificial Sequence
  Synthetically generated peptide
CEWCLNPACVAC

SEQ ID NO: 7384 - protein, 12 aa, Artificial Sequence
  Synthetically generated peptide
CEWCLNPACGGC

SEQ ID NO: 7385 - protein, 12 aa, Artificial Sequence
  Synthetically generated peptide
CEWCLNPACGAC

SEQ ID NO: 7386 - protein, 12 aa, Artificial Sequence
  Synthetically generated peptide
CEWCLNPTCTGC

SEQ ID NO: 7387 - protein, 12 aa, Artificial Sequence
  Synthetically generated peptide
CEWCLNPTCTAC

SEQ ID NO: 7388 - protein, 12 aa, Artificial Sequence
  Synthetically generated peptide
CEWCLNPTCVGC

SEQ ID NO: 7389 - protein, 12 aa, Artificial Sequence
  Synthetically generated peptide
CEWCLNPTCVAC

SEQ ID NO: 7390 - protein, 12 aa, Artificial Sequence
  Synthetically generated peptide
CEWCLNPTCGGC

SEQ ID NO: 7391 - protein, 12 aa, Artificial Sequence
  Synthetically generated peptide
CEWCLNPTCGAC

SEQ ID NO: 7392 - protein, 12 aa, Artificial Sequence
  Synthetically generated peptide
CEWCLNGACTGC

SEQ ID NO: 7393 - protein, 12 aa, Artificial Sequence
  Synthetically generated peptide
CEWCLNGACTAC

SEQ ID NO: 7394 - protein, 12 aa, Artificial Sequence
  Synthetically generated peptide
CEWCLNGACVGC

SEQ ID NO: 7395 - protein, 12 aa, Artificial Sequence
  Synthetically generated peptide
CEWCLNGACVAC

SEQ ID NO: 7396 - protein, 12 aa, Artificial Sequence
  Synthetically generated peptide
CEWCLNGACGGC

SEQ ID NO: 7397 - protein, 12 aa, Artificial Sequence
  Synthetically generated peptide
CEWCLNGACGAC

SEQ ID NO: 7398 - protein, 12 aa, Artificial Sequence
  Synthetically generated peptide
CEWCLNGTCTGC

SEQ ID NO: 7399 - protein, 12 aa, Artificial Sequence
  Synthetically generated peptide
CEWCLNGTCTAC

SEQ ID NO: 7400 - protein, 12 aa, Artificial Sequence
  Synthetically generated peptide
CEWCLNGTCVGC

SEQ ID NO: 7401 - protein, 12 aa, Artificial Sequence
  Synthetically generated peptide
CEWCLNGTCVAC

SEQ ID NO: 7402 - protein, 12 aa, Artificial Sequence
  Synthetically generated peptide
CEWCLNGTCGGC

SEQ ID NO: 7403 - protein, 12 aa, Artificial Sequence
  Synthetically generated peptide
CEWCLNGTCGAC

SEQ ID NO: 7404 - protein, 12 aa, Artificial Sequence
  Synthetically generated peptide
CEWCKNPACTGC

SEQ ID NO: 7405 - protein, 12 aa, Artificial Sequence
  Synthetically generated peptide
CEWCKNPACTAC

SEQ ID NO: 7406 - protein, 12 aa, Artificial Sequence
  Synthetically generated peptide
CEWCKNPACVGC

SEQ ID NO: 7407 - protein, 12 aa, Artificial Sequence
  Synthetically generated peptide
CEWCKNPACVAC

SEQ ID NO: 7408 - protein, 12 aa, Artificial Sequence
  Synthetically generated peptide
CEWCKNPACGGC

SEQ ID NO: 7409 - protein, 12 aa, Artificial Sequence
  Synthetically generated peptide
CEWCKNPACGAC

SEQ ID NO: 7410 - protein, 12 aa, Artificial Sequence
  Synthetically generated peptide
CEWCKNPTCTGC

SEQ ID NO: 7411 - protein, 12 aa, Artificial Sequence
  Synthetically generated peptide
CEWCKNPTCTAC

SEQ ID NO: 7412 - protein, 12 aa, Artificial Sequence
  Synthetically generated peptide
CEWCKNPTCVGC

SEQ ID NO: 7413 - protein, 12 aa, Artificial Sequence
  Synthetically generated peptide
CEWCKNPTCVAC

SEQ ID NO: 7414 - protein, 12 aa, Artificial Sequence
  Synthetically generated peptide
CEWCKNPTCGGC

SEQ ID NO: 7415 - protein, 12 aa, Artificial Sequence
  Synthetically generated peptide
CEWCKNPTCGAC

SEQ ID NO: 7416 - protein, 12 aa, Artificial Sequence
  Synthetically generated peptide
CEWCKNGACTGC

SEQ ID NO: 7417 - protein, 12 aa, Artificial Sequence
  Synthetically generated peptide
CEWCKNGACTAC

SEQ ID NO: 7418 - protein, 12 aa, Artificial Sequence
  Synthetically generated peptide
CEWCKNGACVGC

SEQ ID NO: 7419 - protein, 12 aa, Artificial Sequence
  Synthetically generated peptide
CEWCKNGACVAC

SEQ ID NO: 7420 - protein, 12 aa, Artificial Sequence
  Synthetically generated peptide
CEWCKNGACGGC

SEQ ID NO: 7421 - protein, 12 aa, Artificial Sequence
  Synthetically generated peptide
CEWCKNGACGAC

SEQ ID NO: 7422 - protein, 12 aa, Artificial Sequence
  Synthetically generated peptide
CEWCKNGTCTGC

SEQ ID NO: 7423 - protein, 12 aa, Artificial Sequence
  Synthetically generated peptide
CEWCKNGTCTAC

SEQ ID NO: 7424 - protein, 12 aa, Artificial Sequence
  Synthetically generated peptide
CEWCKNGTCVGC

SEQ ID NO: 7425 - protein, 12 aa, Artificial Sequence
  Synthetically generated peptide
CEWCKNGTCVAC

SEQ ID NO: 7426 - protein, 12 aa, Artificial Sequence
  Synthetically generated peptide
CEWCKNGTCGGC

SEQ ID NO: 7427 - protein, 12 aa, Artificial Sequence
  Synthetically generated peptide
CEWCKNGTCGAC

SEQ ID NO: 7428 - protein, 12 aa, Artificial Sequence
  Synthetically generated peptide
CEWCMNPACTGC

SEQ ID NO: 7429 - protein, 12 aa, Artificial Sequence
  Synthetically generated peptide
CEWCMNPACTAC

SEQ ID NO: 7430 - protein, 12 aa, Artificial Sequence
  Synthetically generated peptide
CEWCMNPACVGC

SEQ ID NO: 7431 - protein, 12 aa, Artificial Sequence
  Synthetically generated peptide
CEWCMNPACVAC

SEQ ID NO: 7432 - protein, 12 aa, Artificial Sequence
  Synthetically generated peptide
CEWCMNPACGGC

SEQ ID NO: 7433 - protein, 12 aa, Artificial Sequence
  Synthetically generated peptide
CEWCMNPACGAC

SEQ ID NO: 7434 - protein, 12 aa, Artificial Sequence
  Synthetically generated peptide
CEWCMNPTCTGC

SEQ ID NO: 7435 - protein, 12 aa, Artificial Sequence
  Synthetically generated peptide
CEWCMNPTCTAC

SEQ ID NO: 7436 - protein, 12 aa, Artificial Sequence
  Synthetically generated peptide
CEWCMNPTCVGC

SEQ ID NO: 7437 - protein, 12 aa, Artificial Sequence
  Synthetically generated peptide
CEWCMNPTCVAC

SEQ ID NO: 7438 - protein, 12 aa, Artificial Sequence
  Synthetically generated peptide
CEWCMNPTCGGC

SEQ ID NO: 7439 - protein, 12 aa, Artificial Sequence
  Synthetically generated peptide
CEWCMNPTCGAC

SEQ ID NO: 7440 - protein, 12 aa, Artificial Sequence
  Synthetically generated peptide
CEWCMNGACTGC

SEQ ID NO: 7441 - protein, 12 aa, Artificial Sequence
  Synthetically generated peptide
CEWCMNGACTAC

SEQ ID NO: 7442 - protein, 12 aa, Artificial Sequence
  Synthetically generated peptide
CEWCMNGACVGC

SEQ ID NO: 7443 - protein, 12 aa, Artificial Sequence
  Synthetically generated peptide
CEWCMNGACVAC

SEQ ID NO: 7444 - protein, 12 aa, Artificial Sequence
  Synthetically generated peptide
CEWCMNGACGGC

SEQ ID NO: 7445 - protein, 12 aa, Artificial Sequence
  Synthetically generated peptide
CEWCMNGACGAC

SEQ ID NO: 7446 - protein, 12 aa, Artificial Sequence
  Synthetically generated peptide
CEWCMNGTCTGC

SEQ ID NO: 7447 - protein, 12 aa, Artificial Sequence
  Synthetically generated peptide
CEWCMNGTCTAC

SEQ ID NO: 7448 - protein, 12 aa, Artificial Sequence
  Synthetically generated peptide
CEWCMNGTCVGC

SEQ ID NO: 7449 - protein, 12 aa, Artificial Sequence
  Synthetically generated peptide
CEWCMNGTCVAC

SEQ ID NO: 7450 - protein, 12 aa, Artificial Sequence
  Synthetically generated peptide
CEWCMNGTCGGC

SEQ ID NO: 7451 - protein, 12 aa, Artificial Sequence
  Synthetically generated peptide
CEWCMNGTCGAC

SEQ ID NO: 7452 - protein, 12 aa, Artificial Sequence
  Synthetically generated peptide
CEWCFNPACTGC

SEQ ID NO: 7453 - protein, 12 aa, Artificial Sequence
  Synthetically generated peptide
CEWCFNPACTAC

SEQ ID NO: 7454 - protein, 12 aa, Artificial Sequence
  Synthetically generated peptide
CEWCFNPACVGC

SEQ ID NO: 7455 - protein, 12 aa, Artificial Sequence
  Synthetically generated peptide
CEWCFNPACVAC

SEQ ID NO: 7456 - protein, 12 aa, Artificial Sequence
  Synthetically generated peptide
CEWCFNPACGGC

SEQ ID NO: 7457 - protein, 12 aa, Artificial Sequence
  Synthetically generated peptide
CEWCFNPACGAC

SEQ ID NO: 7458 - protein, 12 aa, Artificial Sequence
  Synthetically generated peptide
CEWCFNPTCTGC

SEQ ID NO: 7459 - protein, 12 aa, Artificial Sequence
  Synthetically generated peptide
CEWCFNPTCTAC

SEQ ID NO: 7460 - protein, 12 aa, Artificial Sequence
  Synthetically generated peptide
CEWCFNPTCVGC

SEQ ID NO: 7461 - protein, 12 aa, Artificial Sequence
  Synthetically generated peptide
CEWCFNPTCVAC

SEQ ID NO: 7462 - protein, 12 aa, Artificial Sequence
  Synthetically generated peptide
CEWCFNPTCGGC

SEQ ID NO: 7463 - protein, 12 aa, Artificial Sequence
  Synthetically generated peptide
CEWCFNPTCGAC

SEQ ID NO: 7464 - protein, 12 aa, Artificial Sequence
  Synthetically generated peptide
CEWCFNGACTGC

SEQ ID NO: 7465 - protein, 12 aa, Artificial Sequence
  Synthetically generated peptide
CEWCFNGACTAC

SEQ ID NO: 7466 - protein, 12 aa, Artificial Sequence
  Synthetically generated peptide
CEWCFNGACVGC

SEQ ID NO: 7467 - protein, 12 aa, Artificial Sequence
  Synthetically generated peptide
CEWCFNGACVAC

SEQ ID NO: 7468 - protein, 12 aa, Artificial Sequence
  Synthetically generated peptide
CEWCFNGACGGC

SEQ ID NO: 7469 - protein, 12 aa, Artificial Sequence
  Synthetically generated peptide
CEWCFNGACGAC

SEQ ID NO: 7470 - protein, 12 aa, Artificial Sequence
  Synthetically generated peptide
CEWCFNGTCTGC

SEQ ID NO: 7471 - protein, 12 aa, Artificial Sequence
  Synthetically generated peptide
CEWCFNGTCTAC

SEQ ID NO: 7472 - protein, 12 aa, Artificial Sequence
  Synthetically generated peptide
CEWCFNGTCVGC

SEQ ID NO: 7473 - protein, 12 aa, Artificial Sequence
  Synthetically generated peptide
CEWCFNGTCVAC

SEQ ID NO: 7474 - protein, 12 aa, Artificial Sequence
  Synthetically generated peptide
CEWCFNGTCGGC

SEQ ID NO: 7475 - protein, 12 aa, Artificial Sequence
  Synthetically generated peptide
CEWCFNGTCGAC

SEQ ID NO: 7476 - protein, 12 aa, Artificial Sequence
  Synthetically generated peptide
CEWCPNPACTGC

SEQ ID NO: 7477 - protein, 12 aa, Artificial Sequence
  Synthetically generated peptide
CEWCPNPACTAC

SEQ ID NO: 7478 - protein, 12 aa, Artificial Sequence
  Synthetically generated peptide
CEWCPNPACVGC

SEQ ID NO: 7479 - protein, 12 aa, Artificial Sequence
  Synthetically generated peptide
CEWCPNPACVAC

SEQ ID NO: 7480 - protein, 12 aa, Artificial Sequence
  Synthetically generated peptide
CEWCPNPACGGC

SEQ ID NO: 7481 - protein, 12 aa, Artificial Sequence
  Synthetically generated peptide
CEWCPNPACGAC

SEQ ID NO: 7482 - protein, 12 aa, Artificial Sequence
  Synthetically generated peptide
CEWCPNPTCTGC

SEQ ID NO: 7483 - protein, 12 aa, Artificial Sequence
  Synthetically generated peptide
CEWCPNPTCTAC

SEQ ID NO: 7484 - protein, 12 aa, Artificial Sequence
  Synthetically generated peptide
CEWCPNPTCVGC

SEQ ID NO: 7485 - protein, 12 aa, Artificial Sequence
  Synthetically generated peptide
CEWCPNPTCVAC

SEQ ID NO: 7486 - protein, 12 aa, Artificial Sequence
  Synthetically generated peptide
CEWCPNPTCGGC

SEQ ID NO: 7487 - protein, 12 aa, Artificial Sequence
  Synthetically generated peptide
CEWCPNPTCGAC

SEQ ID NO: 7488 - protein, 12 aa, Artificial Sequence
  Synthetically generated peptide
CEWCPNGACTGC

SEQ ID NO: 7489 - protein, 12 aa, Artificial Sequence
  Synthetically generated peptide
CEWCPNGACTAC

SEQ ID NO: 7490 - protein, 12 aa, Artificial Sequence
  Synthetically generated peptide
CEWCPNGACVGC

SEQ ID NO: 7491 - protein, 12 aa, Artificial Sequence
  Synthetically generated peptide
CEWCPNGACVAC

SEQ ID NO: 7492 - protein, 12 aa, Artificial Sequence
  Synthetically generated peptide
CEWCPNGACGGC

SEQ ID NO: 7493 - protein, 12 aa, Artificial Sequence
  Synthetically generated peptide
CEWCPNGACGAC

SEQ ID NO: 7494 - protein, 12 aa, Artificial Sequence
  Synthetically generated peptide
CEWCPNGTCTGC

SEQ ID NO: 7495 - protein, 12 aa, Artificial Sequence
  Synthetically generated peptide
CEWCPNGTCTAC

SEQ ID NO: 7496 - protein, 12 aa, Artificial Sequence
  Synthetically generated peptide
CEWCPNGTCVGC

SEQ ID NO: 7497 - protein, 12 aa, Artificial Sequence
  Synthetically generated peptide
CEWCPNGTCVAC

SEQ ID NO: 7498 - protein, 12 aa, Artificial Sequence
  Synthetically generated peptide
CEWCPNGTCGGC

SEQ ID NO: 7499 - protein, 12 aa, Artificial Sequence
  Synthetically generated peptide
CEWCPNGTCGAC

SEQ ID NO: 7500 - protein, 12 aa, Artificial Sequence
  Synthetically generated peptide
CEWCSNPACTGC

SEQ ID NO: 7501 - protein, 12 aa, Artificial Sequence
  Synthetically generated peptide
CEWCSNPACTAC

SEQ ID NO: 7502 - protein, 12 aa, Artificial Sequence
  Synthetically generated peptide
CEWCSNPACVGC

SEQ ID NO: 7503 - protein, 12 aa, Artificial Sequence
  Synthetically generated peptide
CEWCSNPACVAC

SEQ ID NO: 7504 - protein, 12 aa, Artificial Sequence
  Synthetically generated peptide
CEWCSNPACGGC

SEQ ID NO: 7505 - protein, 12 aa, Artificial Sequence
  Synthetically generated peptide
CEWCSNPACGAC

SEQ ID NO: 7506 - protein, 12 aa, Artificial Sequence
  Synthetically generated peptide
CEWCSNPTCTGC

SEQ ID NO: 7507 - protein, 12 aa, Artificial Sequence
  Synthetically generated peptide
CEWCSNPTCTAC

SEQ ID NO: 7508 - protein, 12 aa, Artificial Sequence
  Synthetically generated peptide
CEWCSNPTCVGC

SEQ ID NO: 7509 - protein, 12 aa, Artificial Sequence
  Synthetically generated peptide
CEWCSNPTCVAC

SEQ ID NO: 7510 - protein, 12 aa, Artificial Sequence
  Synthetically generated peptide
CEWCSNPTCGGC

SEQ ID NO: 7511 - protein, 12 aa, Artificial Sequence
  Synthetically generated peptide
CEWCSNPTCGAC

SEQ ID NO: 7512 - protein, 12 aa, Artificial Sequence
  Synthetically generated peptide
CEWCSNGACTGC

SEQ ID NO: 7513 - protein, 12 aa, Artificial Sequence
  Synthetically generated peptide
CEWCSNGACTAC

SEQ ID NO: 7514 - protein, 12 aa, Artificial Sequence
  Synthetically generated peptide
CEWCSNGACVGC

SEQ ID NO: 7515 - protein, 12 aa, Artificial Sequence
  Synthetically generated peptide
CEWCSNGACVAC

SEQ ID NO: 7516 - protein, 12 aa, Artificial Sequence
  Synthetically generated peptide
CEWCSNGACGGC

SEQ ID NO: 7517 - protein, 12 aa, Artificial Sequence
  Synthetically generated peptide
CEWCSNGACGAC

SEQ ID NO: 7518 - protein, 12 aa, Artificial Sequence
  Synthetically generated peptide
CEWCSNGTCTGC

SEQ ID NO: 7519 - protein, 12 aa, Artificial Sequence
  Synthetically generated peptide
CEWCSNGTCTAC

SEQ ID NO: 7520 - protein, 12 aa, Artificial Sequence
  Synthetically generated peptide
CEWCSNGTCVGC

SEQ ID NO: 7521 - protein, 12 aa, Artificial Sequence
  Synthetically generated peptide
CEWCSNGTCVAC

SEQ ID NO: 7522 - protein, 12 aa, Artificial Sequence
  Synthetically generated peptide
CEWCSNGTCGGC

SEQ ID NO: 7523 - protein, 12 aa, Artificial Sequence
  Synthetically generated peptide
CEWCSNGTCGAC

SEQ ID NO: 7524 - protein, 12 aa, Artificial Sequence
  Synthetically generated peptide
CEWCTNPACTGC

SEQ ID NO: 7525 - protein, 12 aa, Artificial Sequence
  Synthetically generated peptide
CEWCTNPACTAC

SEQ ID NO: 7526 - protein, 12 aa, Artificial Sequence
  Synthetically generated peptide
CEWCTNPACVGC

SEQ ID NO: 7527 - protein, 12 aa, Artificial Sequence
  Synthetically generated peptide
CEWCTNPACVAC

SEQ ID NO: 7528 - protein, 12 aa, Artificial Sequence
  Synthetically generated peptide
CEWCTNPACGGC

SEQ ID NO: 7529 - protein, 12 aa, Artificial Sequence
  Synthetically generated peptide
CEWCTNPACGAC

SEQ ID NO: 7530 - protein, 12 aa, Artificial Sequence
  Synthetically generated peptide
CEWCTNPTCTGC

SEQ ID NO: 7531 - protein, 12 aa, Artificial Sequence
  Synthetically generated peptide
CEWCTNPTCTAC

SEQ ID NO: 7532 - protein, 12 aa, Artificial Sequence
  Synthetically generated peptide
CEWCTNPTCVGC

SEQ ID NO: 7533 - protein, 12 aa, Artificial Sequence
  Synthetically generated peptide
CEWCTNPTCVAC

SEQ ID NO: 7534 - protein, 12 aa, Artificial Sequence
  Synthetically generated peptide
CEWCTNPTCGGC

SEQ ID NO: 7535 - protein, 12 aa, Artificial Sequence
  Synthetically generated peptide
CEWCTNPTCGAC

SEQ ID NO: 7536 - protein, 12 aa, Artificial Sequence
  Synthetically generated peptide
CEWCTNGACTGC

SEQ ID NO: 7537 - protein, 12 aa, Artificial Sequence
  Synthetically generated peptide
CEWCTNGACTAC

SEQ ID NO: 7538 - protein, 12 aa, Artificial Sequence
  Synthetically generated peptide
CEWCTNGACVGC

SEQ ID NO: 7539 - protein, 12 aa, Artificial Sequence
  Synthetically generated peptide
CEWCTNGACVAC

SEQ ID NO: 7540 - protein, 12 aa, Artificial Sequence
  Synthetically generated peptide
CEWCTNGACGGC

SEQ ID NO: 7541 - protein, 12 aa, Artificial Sequence
  Synthetically generated peptide
CEWCTNGACGAC

SEQ ID NO: 7542 - protein, 12 aa, Artificial Sequence
  Synthetically generated peptide
CEWCTNGTCTGC

SEQ ID NO: 7543 - protein, 12 aa, Artificial Sequence
  Synthetically generated peptide
CEWCTNGTCTAC

SEQ ID NO: 7544 - protein, 12 aa, Artificial Sequence
  Synthetically generated peptide
CEWCTNGTCVGC

SEQ ID NO: 7545 - protein, 12 aa, Artificial Sequence
  Synthetically generated peptide
CEWCTNGTCVAC

SEQ ID NO: 7546 - protein, 12 aa, Artificial Sequence
  Synthetically generated peptide
CEWCTNGTCGGC

SEQ ID NO: 7547 - protein, 12 aa, Artificial Sequence
  Synthetically generated peptide
CEWCTNGTCGAC

SEQ ID NO: 7548 - protein, 12 aa, Artificial Sequence
  Synthetically generated peptide
CEWCWNPACTGC

SEQ ID NO: 7549 - protein, 12 aa, Artificial Sequence
  Synthetically generated peptide
CEWCWNPACTAC

SEQ ID NO: 7550 - protein, 12 aa, Artificial Sequence
  Synthetically generated peptide
CEWCWNPACVGC

SEQ ID NO: 7551 - protein, 12 aa, Artificial Sequence
  Synthetically generated peptide
CEWCWNPACVAC

SEQ ID NO: 7552 - protein, 12 aa, Artificial Sequence
  Synthetically generated peptide
CEWCWNPACGGC

SEQ ID NO: 7553 - protein, 12 aa, Artificial Sequence
  Synthetically generated peptide
CEWCWNPACGAC

SEQ ID NO: 7554 - protein, 12 aa, Artificial Sequence
  Synthetically generated peptide
CEWCWNPTCTGC

SEQ ID NO: 7555 - protein, 12 aa, Artificial Sequence
  Synthetically generated peptide
CEWCWNPTCTAC

SEQ ID NO: 7556 - protein, 12 aa, Artificial Sequence
  Synthetically generated peptide
CEWCWNPTCVGC

SEQ ID NO: 7557 - protein, 12 aa, Artificial Sequence
  Synthetically generated peptide
CEWCWNPTCVAC

SEQ ID NO: 7558 - protein, 12 aa, Artificial Sequence
  Synthetically generated peptide
CEWCWNPTCGGC

SEQ ID NO: 7559 - protein, 12 aa, Artificial Sequence
  Synthetically generated peptide
CEWCWNPTCGAC

SEQ ID NO: 7560 - protein, 12 aa, Artificial Sequence
  Synthetically generated peptide
CEWCWNGACTGC

SEQ ID NO: 7561 - protein, 12 aa, Artificial Sequence
  Synthetically generated peptide
CEWCWNGACTAC

SEQ ID NO: 7562 - protein, 12 aa, Artificial Sequence
  Synthetically generated peptide
CEWCWNGACVGC

SEQ ID NO: 7563 - protein, 12 aa, Artificial Sequence
  Synthetically generated peptide
CEWCWNGACVAC

SEQ ID NO: 7564 - protein, 12 aa, Artificial Sequence
  Synthetically generated peptide
CEWCWNGACGGC

SEQ ID NO: 7565 - protein, 12 aa, Artificial Sequence
  Synthetically generated peptide
CEWCWNGACGAC

SEQ ID NO: 7566 - protein, 12 aa, Artificial Sequence
  Synthetically generated peptide
CEWCWNGTCTGC

SEQ ID NO: 7567 - protein, 12 aa, Artificial Sequence
  Synthetically generated peptide
CEWCWNGTCTAC

SEQ ID NO: 7568 - protein, 12 aa, Artificial Sequence
  Synthetically generated peptide
CEWCWNGTCVGC

SEQ ID NO: 7569 - protein, 12 aa, Artificial Sequence
  Synthetically generated peptide
CEWCWNGTCVAC

SEQ ID NO: 7570 - protein, 12 aa, Artificial Sequence
  Synthetically generated peptide
CEWCWNGTCGGC

SEQ ID NO: 7571 - protein, 12 aa, Artificial Sequence
  Synthetically generated peptide
CEWCWNGTCGAC

SEQ ID NO: 7572 - protein, 12 aa, Artificial Sequence
  Synthetically generated peptide
CEWCYNPACTGC

SEQ ID NO: 7573 - protein, 12 aa, Artificial Sequence
  Synthetically generated peptide
CEWCYNPACTAC

SEQ ID NO: 7574 - protein, 12 aa, Artificial Sequence
  Synthetically generated peptide
CEWCYNPACVGC

SEQ ID NO: 7575 - protein, 12 aa, Artificial Sequence
  Synthetically generated peptide
CEWCYNPACVAC

SEQ ID NO: 7576 - protein, 12 aa, Artificial Sequence
  Synthetically generated peptide
CEWCYNPACGGC

SEQ ID NO: 7577 - protein, 12 aa, Artificial Sequence
  Synthetically generated peptide
CEWCYNPACGAC

SEQ ID NO: 7578 - protein, 12 aa, Artificial Sequence
  Synthetically generated peptide
CEWCYNPTCTGC

SEQ ID NO: 7579 - protein, 12 aa, Artificial Sequence
  Synthetically generated peptide
CEWCYNPTCTAC

SEQ ID NO: 7580 - protein, 12 aa, Artificial Sequence
  Synthetically generated peptide
CEWCYNPTCVGC

SEQ ID NO: 7581 - protein, 12 aa, Artificial Sequence
  Synthetically generated peptide
CEWCYNPTCVAC

SEQ ID NO: 7582 - protein, 12 aa, Artificial Sequence
  Synthetically generated peptide
CEWCYNPTCGGC

SEQ ID NO: 7583 - protein, 12 aa, Artificial Sequence
  Synthetically generated peptide
CEWCYNPTCGAC

SEQ ID NO: 7584 - protein, 12 aa, Artificial Sequence
  Synthetically generated peptide
CEWCYNGACTGC

SEQ ID NO: 7585 - protein, 12 aa, Artificial Sequence
  Synthetically generated peptide
CEWCYNGACTAC

SEQ ID NO: 7586 - protein, 12 aa, Artificial Sequence
  Synthetically generated peptide
CEWCYNGACVGC

SEQ ID NO: 7587 - protein, 12 aa, Artificial Sequence
  Synthetically generated peptide
CEWCYNGACVAC

SEQ ID NO: 7588 - protein, 12 aa, Artificial Sequence
  Synthetically generated peptide
CEWCYNGACGGC

SEQ ID NO: 7589 - protein, 12 aa, Artificial Sequence
  Synthetically generated peptide
CEWCYNGACGAC

SEQ ID NO: 7590 - protein, 12 aa, Artificial Sequence
  Synthetically generated peptide
CEWCYNGTCTGC

SEQ ID NO: 7591 - protein, 12 aa, Artificial Sequence
  Synthetically generated peptide
CEWCYNGTCTAC

SEQ ID NO: 7592 - protein, 12 aa, Artificial Sequence
  Synthetically generated peptide
CEWCYNGTCVGC

SEQ ID NO: 7593 - protein, 12 aa, Artificial Sequence
  Synthetically generated peptide
CEWCYNGTCVAC

SEQ ID NO: 7594 - protein, 12 aa, Artificial Sequence
  Synthetically generated peptide
CEWCYNGTCGGC

SEQ ID NO: 7595 - protein, 12 aa, Artificial Sequence
  Synthetically generated peptide
CEWCYNGTCGAC

SEQ ID NO: 7596 - protein, 12 aa, Artificial Sequence
  Synthetically generated peptide
CEWCVNPACTGC

SEQ ID NO: 7597 - protein, 12 aa, Artificial Sequence
  Synthetically generated peptide
CEWCVNPACTAC

SEQ ID NO: 7598 - protein, 12 aa, Artificial Sequence
  Synthetically generated peptide
CEWCVNPACVGC

SEQ ID NO: 7599 - protein, 12 aa, Artificial Sequence
  Synthetically generated peptide
CEWCVNPACVAC

SEQ ID NO: 7600 - protein, 12 aa, Artificial Sequence
  Synthetically generated peptide
CEWCVNPACGGC

SEQ ID NO: 7601 - protein, 12 aa, Artificial Sequence
  Synthetically generated peptide
CEWCVNPACGAC

SEQ ID NO: 7602 - protein, 12 aa, Artificial Sequence
  Synthetically generated peptide
CEWCVNPTCTGC

SEQ ID NO: 7603 - protein, 12 aa, Artificial Sequence
  Synthetically generated peptide
CEWCVNPTCTAC

SEQ ID NO: 7604 - protein, 12 aa, Artificial Sequence
  Synthetically generated peptide
CEWCVNPTCVGC

SEQ ID NO: 7605 - protein, 12 aa, Artificial Sequence
  Synthetically generated peptide
CEWCVNPTCVAC

SEQ ID NO: 7606 - protein, 12 aa, Artificial Sequence
  Synthetically generated peptide
CEWCVNPTCGGC

SEQ ID NO: 7607 - protein, 12 aa, Artificial Sequence
  Synthetically generated peptide
CEWCVNPTCGAC

SEQ ID NO: 7608 - protein, 12 aa, Artificial Sequence
  Synthetically generated peptide
CEWCVNGACTGC

SEQ ID NO: 7609 - protein, 12 aa, Artificial Sequence
  Synthetically generated peptide
CEWCVNGACTAC

SEQ ID NO: 7610 - protein, 12 aa, Artificial Sequence
  Synthetically generated peptide
CEWCVNGACVGC

SEQ ID NO: 7611 - protein, 12 aa, Artificial Sequence
  Synthetically generated peptide
CEWCVNGACVAC

SEQ ID NO: 7612 - protein, 12 aa, Artificial Sequence
  Synthetically generated peptide
CEWCVNGACGGC

SEQ ID NO: 7613 - protein, 12 aa, Artificial Sequence
  Synthetically generated peptide
CEWCVNGACGAC

SEQ ID NO: 7614 - protein, 12 aa, Artificial Sequence
  Synthetically generated peptide
CEWCVNGTCTGC

SEQ ID NO: 7615 - protein, 12 aa, Artificial Sequence
  Synthetically generated peptide
CEWCVNGTCTAC

SEQ ID NO: 7616 - protein, 12 aa, Artificial Sequence
  Synthetically generated peptide
CEWCVNGTCVGC

SEQ ID NO: 7617 - protein, 12 aa, Artificial Sequence
  Synthetically generated peptide
CEWCVNGTCVAC

SEQ ID NO: 7618 - protein, 12 aa, Artificial Sequence
  Synthetically generated peptide
CEWCVNGTCGGC

SEQ ID NO: 7619 - protein, 12 aa, Artificial Sequence
  Synthetically generated peptide
CEWCVNGTCGAC

SEQ ID NO: 7620 - protein, 11 aa, Artificial Sequence
  Synthetically generated peptide
CEWCNPACTGC

SEQ ID NO: 7621 - protein, 11 aa, Artificial Sequence
  Synthetically generated peptide
CEWCNPACTAC

SEQ ID NO: 7622 - protein, 11 aa, Artificial Sequence
  Synthetically generated peptide
CEWCNPACVGC

SEQ ID NO: 7623 - protein, 11 aa, Artificial Sequence
  Synthetically generated peptide
CEWCNPACVAC

SEQ ID NO: 7624 - protein, 11 aa, Artificial Sequence
  Synthetically generated peptide
CEWCNPACGGC

SEQ ID NO: 7625 - protein, 11 aa, Artificial Sequence
  Synthetically generated peptide
CEWCNPACGAC

SEQ ID NO: 7626 - protein, 11 aa, Artificial Sequence
  Synthetically generated peptide
CEWCNPTCTGC

SEQ ID NO: 7627 - protein, 11 aa, Artificial Sequence
  Synthetically generated peptide
CEWCNPTCTAC

SEQ ID NO: 7628 - protein, 11 aa, Artificial Sequence
  Synthetically generated peptide
CEWCNPTCVGC

SEQ ID NO: 7629 - protein, 11 aa, Artificial Sequence
  Synthetically generated peptide
CEWCNPTCVAC

SEQ ID NO: 7630 - protein, 11 aa, Artificial Sequence
  Synthetically generated peptide
CEWCNPTCGGC

SEQ ID NO: 7631 - protein, 11 aa, Artificial Sequence
  Synthetically generated peptide
CEWCNPTCGAC

SEQ ID NO: 7632 - protein, 11 aa, Artificial Sequence
  Synthetically generated peptide
CEWCNGACTGC

SEQ ID NO: 7633 - protein, 11 aa, Artificial Sequence
  Synthetically generated peptide
CEWCNGACTAC

SEQ ID NO: 7634 - protein, 11 aa, Artificial Sequence
  Synthetically generated peptide
CEWCNGACVGC

SEQ ID NO: 7635 - protein, 11 aa, Artificial Sequence
  Synthetically generated peptide
CEWCNGACVAC

SEQ ID NO: 7636 - protein, 11 aa, Artificial Sequence
  Synthetically generated peptide
CEWCNGACGGC

SEQ ID NO: 7637 - protein, 11 aa, Artificial Sequence
  Synthetically generated peptide
CEWCNGACGAC

SEQ ID NO: 7638 - protein, 11 aa, Artificial Sequence
  Synthetically generated peptide
CEWCNGTCTGC

SEQ ID NO: 7639 - protein, 11 aa, Artificial Sequence
  Synthetically generated peptide
CEWCNGTCTAC

SEQ ID NO: 7640 - protein, 11 aa, Artificial Sequence
  Synthetically generated peptide
CEWCNGTCVGC

SEQ ID NO: 7641 - protein, 11 aa, Artificial Sequence
  Synthetically generated peptide
CEWCNGTCVAC

SEQ ID NO: 7642 - protein, 11 aa, Artificial Sequence
  Synthetically generated peptide
CEWCNGTCGGC

SEQ ID NO: 7643 - protein, 11 aa, Artificial Sequence
  Synthetically generated peptide
CEWCNGTCGAC

SEQ ID NO: 7644 - protein, 12 aa, Artificial Sequence
  Synthetically generated peptide
CEFCANPACTGC

SEQ ID NO: 7645 - protein, 12 aa, Artificial Sequence
  Synthetically generated peptide
CEFCANPACTAC

SEQ ID NO: 7646 - protein, 12 aa, Artificial Sequence
  Synthetically generated peptide
CEFCANPACVGC

SEQ ID NO: 7647 - protein, 12 aa, Artificial Sequence
  Synthetically generated peptide
CEFCANPACVAC

SEQ ID NO: 7648 - protein, 12 aa, Artificial Sequence
  Synthetically generated peptide
CEFCANPACGGC

SEQ ID NO: 7649 - protein, 12 aa, Artificial Sequence
  Synthetically generated peptide
CEFCANPACGAC

SEQ ID NO: 7650 - protein, 12 aa, Artificial Sequence
  Synthetically generated peptide
CEFCANPTCTGC

SEQ ID NO: 7651 - protein, 12 aa, Artificial Sequence
  Synthetically generated peptide
CEFCANPTCTAC

SEQ ID NO: 7652 - protein, 12 aa, Artificial Sequence
  Synthetically generated peptide
CEFCANPTCVGC

SEQ ID NO: 7653 - protein, 12 aa, Artificial Sequence
  Synthetically generated peptide
CEFCANPTCVAC

SEQ ID NO: 7654 - protein, 12 aa, Artificial Sequence
  Synthetically generated peptide
CEFCANPTCGGC

SEQ ID NO: 7655 - protein, 12 aa, Artificial Sequence
  Synthetically generated peptide
CEFCANPTCGAC

SEQ ID NO: 7656 - protein, 12 aa, Artificial Sequence
  Synthetically generated peptide
CEFCANGACTGC

SEQ ID NO: 7657 - protein, 12 aa, Artificial Sequence
  Synthetically generated peptide
CEFCANGACTAC

SEQ ID NO: 7658 - protein, 12 aa, Artificial Sequence
  Synthetically generated peptide
CEFCANGACVGC

SEQ ID NO: 7659 - protein, 12 aa, Artificial Sequence
  Synthetically generated peptide
CEFCANGACVAC

SEQ ID NO: 7660 - protein, 12 aa, Artificial Sequence
  Synthetically generated peptide
CEFCANGACGGC

SEQ ID NO: 7661 - protein, 12 aa, Artificial Sequence
  Synthetically generated peptide
CEFCANGACGAC

SEQ ID NO: 7662 - protein, 12 aa, Artificial Sequence
  Synthetically generated peptide
CEFCANGTCTGC

SEQ ID NO: 7663 - protein, 12 aa, Artificial Sequence
  Synthetically generated peptide
CEFCANGTCTAC

SEQ ID NO: 7664 - protein, 12 aa, Artificial Sequence
  Synthetically generated peptide
CEFCANGTCVGC

SEQ ID NO: 7665 - protein, 12 aa, Artificial Sequence
  Synthetically generated peptide
CEFCANGTCVAC

SEQ ID NO: 7666 - protein, 12 aa, Artificial Sequence
  Synthetically generated peptide
CEFCANGTCGGC

SEQ ID NO: 7667 - protein, 12 aa, Artificial Sequence
  Synthetically generated peptide
CEFCANGTCGAC

SEQ ID NO: 7668 - protein, 12 aa, Artificial Sequence
  Synthetically generated peptide
CEFCRNPACTGC

SEQ ID NO: 7669 - protein, 12 aa, Artificial Sequence
  Synthetically generated peptide
CEFCRNPACTAC

SEQ ID NO: 7670 - protein, 12 aa, Artificial Sequence
  Synthetically generated peptide
CEFCRNPACVGC

SEQ ID NO: 7671 - protein, 12 aa, Artificial Sequence
  Synthetically generated peptide
CEFCRNPACVAC

SEQ ID NO: 7672 - protein, 12 aa, Artificial Sequence
  Synthetically generated peptide
CEFCRNPACGGC

SEQ ID NO: 7673 - protein, 12 aa, Artificial Sequence
  Synthetically generated peptide
CEFCRNPACGAC

SEQ ID NO: 7674 - protein, 12 aa, Artificial Sequence
  Synthetically generated peptide
CEFCRNPTCTGC

SEQ ID NO: 7675 - protein, 12 aa, Artificial Sequence
  Synthetically generated peptide
CEFCRNPTCTAC

SEQ ID NO: 7676 - protein, 12 aa, Artificial Sequence
  Synthetically generated peptide
CEFCRNPTCVGC

SEQ ID NO: 7677 - protein, 12 aa, Artificial Sequence
  Synthetically generated peptide
CEFCRNPTCVAC

SEQ ID NO: 7678 - protein, 12 aa, Artificial Sequence
  Synthetically generated peptide
CEFCRNPTCGGC

SEQ ID NO: 7679 - protein, 12 aa, Artificial Sequence
  Synthetically generated peptide
CEFCRNPTCGAC

SEQ ID NO: 7680 - protein, 12 aa, Artificial Sequence
  Synthetically generated peptide
CEFCRNGACTGC

SEQ ID NO: 7681 - protein, 12 aa, Artificial Sequence
  Synthetically generated peptide
CEFCRNGACTAC

SEQ ID NO: 7682 - protein, 12 aa, Artificial Sequence
  Synthetically generated peptide
CEFCRNGACVGC

SEQ ID NO: 7683 - protein, 12 aa, Artificial Sequence
  Synthetically generated peptide
CEFCRNGACVAC

SEQ ID NO: 7684 - protein, 12 aa, Artificial Sequence
  Synthetically generated peptide
CEFCRNGACGGC

SEQ ID NO: 7685 - protein, 12 aa, Artificial Sequence
  Synthetically generated peptide
CEFCRNGACGAC

SEQ ID NO: 7686 - protein, 12 aa, Artificial Sequence
  Synthetically generated peptide
CEFCRNGTCTGC

SEQ ID NO: 7687 - protein, 12 aa, Artificial Sequence
  Synthetically generated peptide
CEFCRNGTCTAC

SEQ ID NO: 7688 - protein, 12 aa, Artificial Sequence
  Synthetically generated peptide
CEFCRNGTCVGC

SEQ ID NO: 7689 - protein, 12 aa, Artificial Sequence
  Synthetically generated peptide
CEFCRNGTCVAC

SEQ ID NO: 7690 - protein, 12 aa, Artificial Sequence
  Synthetically generated peptide
CEFCRNGTCGGC

SEQ ID NO: 7691 - protein, 12 aa, Artificial Sequence
  Synthetically generated peptide
CEFCRNGTCGAC

SEQ ID NO: 7692 - protein, 12 aa, Artificial Sequence
  Synthetically generated peptide
CEFCNNPACTGC

SEQ ID NO: 7693 - protein, 12 aa, Artificial Sequence
  Synthetically generated peptide
CEFCNNPACTAC

SEQ ID NO: 7694 - protein, 12 aa, Artificial Sequence
  Synthetically generated peptide
CEFCNNPACVGC

SEQ ID NO: 7695 - protein, 12 aa, Artificial Sequence
  Synthetically generated peptide
CEFCNNPACVAC

SEQ ID NO: 7696 - protein, 12 aa, Artificial Sequence
  Synthetically generated peptide
CEFCNNPACGGC

SEQ ID NO: 7697 - protein, 12 aa, Artificial Sequence
  Synthetically generated peptide
CEFCNNPACGAC

SEQ ID NO: 7698 - protein, 12 aa, Artificial Sequence
  Synthetically generated peptide
CEFCNNPTCTGC

SEQ ID NO: 7699 - protein, 12 aa, Artificial Sequence
  Synthetically generated peptide
CEFCNNPTCTAC

SEQ ID NO: 7700 - protein, 12 aa, Artificial Sequence
  Synthetically generated peptide
CEFCNNPTCVGC

SEQ ID NO: 7701 - protein, 12 aa, Artificial Sequence
  Synthetically generated peptide
CEFCNNPTCVAC

SEQ ID NO: 7702 - protein, 12 aa, Artificial Sequence
  Synthetically generated peptide
CEFCNNPTCGGC

SEQ ID NO: 7703 - protein, 12 aa, Artificial Sequence
  Synthetically generated peptide
CEFCNNPTCGAC

SEQ ID NO: 7704 - protein, 12 aa, Artificial Sequence
  Synthetically generated peptide
CEFCNNGACTGC

SEQ ID NO: 7705 - protein, 12 aa, Artificial Sequence
  Synthetically generated peptide
CEFCNNGACTAC

SEQ ID NO: 7706 - protein, 12 aa, Artificial Sequence
  Synthetically generated peptide
CEFCNNGACVGC

SEQ ID NO: 7707 - protein, 12 aa, Artificial Sequence
  Synthetically generated peptide
CEFCNNGACVAC

SEQ ID NO: 7708 - protein, 12 aa, Artificial Sequence
  Synthetically generated peptide
CEFCNNGACGGC

SEQ ID NO: 7709 - protein, 12 aa, Artificial Sequence
  Synthetically generated peptide
CEFCNNGACGAC

SEQ ID NO: 7710 - protein, 12 aa, Artificial Sequence
  Synthetically generated peptide
CEFCNNGTCTGC

SEQ ID NO: 7711 - protein, 12 aa, Artificial Sequence
  Synthetically generated peptide
CEFCNNGTCTAC

SEQ ID NO: 7712 - protein, 12 aa, Artificial Sequence
  Synthetically generated peptide
CEFCNNGTCVGC

SEQ ID NO: 7713 - protein, 12 aa, Artificial Sequence
  Synthetically generated peptide
CEFCNNGTCVAC

SEQ ID NO: 7714 - protein, 12 aa, Artificial Sequence
  Synthetically generated peptide
CEFCNNGTCGGC

SEQ ID NO: 7715 - protein, 12 aa, Artificial Sequence
  Synthetically generated peptide
CEFCNNGTCGAC

SEQ ID NO: 7716 - protein, 12 aa, Artificial Sequence
  Synthetically generated peptide
CEFCDNPACTGC

SEQ ID NO: 7717 - protein, 12 aa, Artificial Sequence
  Synthetically generated peptide
CEFCDNPACTAC

SEQ ID NO: 7718 - protein, 12 aa, Artificial Sequence
  Synthetically generated peptide
CEFCDNPACVGC

SEQ ID NO: 7719 - protein, 12 aa, Artificial Sequence
  Synthetically generated peptide
CEFCDNPACVAC

SEQ ID NO: 7720 - protein, 12 aa, Artificial Sequence
  Synthetically generated peptide
CEFCDNPACGGC

SEQ ID NO: 7721 - protein, 12 aa, Artificial Sequence
  Synthetically generated peptide
CEFCDNPACGAC

SEQ ID NO: 7722 - protein, 12 aa, Artificial Sequence
  Synthetically generated peptide
CEFCDNPTCTGC

SEQ ID NO: 7723 - protein, 12 aa, Artificial Sequence
  Synthetically generated peptide
CEFCDNPTCTAC

SEQ ID NO: 7724 - protein, 12 aa, Artificial Sequence
  Synthetically generated peptide
CEFCDNPTCVGC

SEQ ID NO: 7725 - protein, 12 aa, Artificial Sequence
  Synthetically generated peptide
CEFCDNPTCVAC

SEQ ID NO: 7726 - protein, 12 aa, Artificial Sequence
  Synthetically generated peptide
CEFCDNPTCGGC

SEQ ID NO: 7727 - protein, 12 aa, Artificial Sequence
  Synthetically generated peptide
CEFCDNPTCGAC

SEQ ID NO: 7728 - protein, 12 aa, Artificial Sequence
  Synthetically generated peptide
CEFCDNGACTGC

SEQ ID NO: 7729 - protein, 12 aa, Artificial Sequence
  Synthetically generated peptide
CEFCDNGACTAC

SEQ ID NO: 7730 - protein, 12 aa, Artificial Sequence
  Synthetically generated peptide
CEFCDNGACVGC

SEQ ID NO: 7731 - protein, 12 aa, Artificial Sequence
  Synthetically generated peptide
CEFCDNGACVAC

SEQ ID NO: 7732 - protein, 12 aa, Artificial Sequence
  Synthetically generated peptide
CEFCDNGACGGC

SEQ ID NO: 7733 - protein, 12 aa, Artificial Sequence
  Synthetically generated peptide
CEFCDNGACGAC

SEQ ID NO: 7734 - protein, 12 aa, Artificial Sequence
  Synthetically generated peptide
CEFCDNGTCTGC

SEQ ID NO: 7735 - protein, 12 aa, Artificial Sequence
  Synthetically generated peptide
CEFCDNGTCTAC

SEQ ID NO: 7736 - protein, 12 aa, Artificial Sequence
  Synthetically generated peptide
CEFCDNGTCVGC

SEQ ID NO: 7737 - protein, 12 aa, Artificial Sequence
  Synthetically generated peptide
CEFCDNGTCVAC

SEQ ID NO: 7738 - protein, 12 aa, Artificial Sequence
  Synthetically generated peptide
CEFCDNGTCGGC

SEQ ID NO: 7739 - protein, 12 aa, Artificial Sequence
  Synthetically generated peptide
CEFCDNGTCGAC

SEQ ID NO: 7740 - protein, 12 aa, Artificial Sequence
  Synthetically generated peptide
CEFCQNPACTGC

SEQ ID NO: 7741 - protein, 12 aa, Artificial Sequence
  Synthetically generated peptide
CEFCQNPACTAC

SEQ ID NO: 7742 - protein, 12 aa, Artificial Sequence
  Synthetically generated peptide
CEFCQNPACVGC

SEQ ID NO: 7743 - protein, 12 aa, Artificial Sequence
  Synthetically generated peptide
CEFCQNPACVAC

SEQ ID NO: 7744 - protein, 12 aa, Artificial Sequence
  Synthetically generated peptide
CEFCQNPACGGC

SEQ ID NO: 7745 - protein, 12 aa, Artificial Sequence
  Synthetically generated peptide
CEFCQNPACGAC

SEQ ID NO: 7746 - protein, 12 aa, Artificial Sequence
  Synthetically generated peptide
CEFCQNPTCTGC

SEQ ID NO: 7747 - protein, 12 aa, Artificial Sequence
  Synthetically generated peptide
CEFCQNPTCTAC

SEQ ID NO: 7748 - protein, 12 aa, Artificial Sequence
  Synthetically generated peptide
CEFCQNPTCVGC

SEQ ID NO: 7749 - protein, 12 aa, Artificial Sequence
  Synthetically generated peptide
CEFCQNPTCVAC

SEQ ID NO: 7750 - protein, 12 aa, Artificial Sequence
  Synthetically generated peptide
CEFCQNPTCGGC

SEQ ID NO: 7751 - protein, 12 aa, Artificial Sequence
  Synthetically generated peptide
CEFCQNPTCGAC

SEQ ID NO: 7752 - protein, 12 aa, Artificial Sequence
  Synthetically generated peptide
CEFCQNGACTGC

SEQ ID NO: 7753 - protein, 12 aa, Artificial Sequence
  Synthetically generated peptide
CEFCQNGACTAC

SEQ ID NO: 7754 - protein, 12 aa, Artificial Sequence
  Synthetically generated peptide
CEFCQNGACVGC

SEQ ID NO: 7755 - protein, 12 aa, Artificial Sequence
  Synthetically generated peptide
CEFCQNGACVAC

SEQ ID NO: 7756 - protein, 12 aa, Artificial Sequence
  Synthetically generated peptide
CEFCQNGACGGC

SEQ ID NO: 7757 - protein, 12 aa, Artificial Sequence
  Synthetically generated peptide
CEFCQNGACGAC

SEQ ID NO: 7758 - protein, 12 aa, Artificial Sequence
  Synthetically generated peptide
CEFCQNGTCTGC

SEQ ID NO: 7759 - protein, 12 aa, Artificial Sequence
  Synthetically generated peptide
CEFCQNGTCTAC

SEQ ID NO: 7760 - protein, 12 aa, Artificial Sequence
  Synthetically generated peptide
CEFCQNGTCVGC

SEQ ID NO: 7761 - protein, 12 aa, Artificial Sequence
  Synthetically generated peptide
CEFCQNGTCVAC

SEQ ID NO: 7762 - protein, 12 aa, Artificial Sequence
  Synthetically generated peptide
CEFCQNGTCGGC

SEQ ID NO: 7763 - protein, 12 aa, Artificial Sequence
  Synthetically generated peptide
CEFCQNGTCGAC

SEQ ID NO: 7764 - protein, 12 aa, Artificial Sequence
  Synthetically generated peptide
CEFCENPACTGC

SEQ ID NO: 7765 - protein, 12 aa, Artificial Sequence
  Synthetically generated peptide
CEFCENPACTAC

SEQ ID NO: 7766 - protein, 12 aa, Artificial Sequence
  Synthetically generated peptide
CEFCENPACVGC

SEQ ID NO: 7767 - protein, 12 aa, Artificial Sequence
  Synthetically generated peptide
CEFCENPACVAC

SEQ ID NO: 7768 - protein, 12 aa, Artificial Sequence
  Synthetically generated peptide
CEFCENPACGGC

SEQ ID NO: 7769 - protein, 12 aa, Artificial Sequence
  Synthetically generated peptide
CEFCENPACGAC

SEQ ID NO: 7770 - protein, 12 aa, Artificial Sequence
  Synthetically generated peptide
CEFCENPTCTGC

SEQ ID NO: 7771 - protein, 12 aa, Artificial Sequence
  Synthetically generated peptide
CEFCENPTCTAC

SEQ ID NO: 7772 - protein, 12 aa, Artificial Sequence
  Synthetically generated peptide
CEFCENPTCVGC

SEQ ID NO: 7773 - protein, 12 aa, Artificial Sequence
  Synthetically generated peptide
CEFCENPTCVAC

SEQ ID NO: 7774 - protein, 12 aa, Artificial Sequence
  Synthetically generated peptide
CEFCENPTCGGC

SEQ ID NO: 7775 - protein, 12 aa, Artificial Sequence
  Synthetically generated peptide
CEFCENPTCGAC

SEQ ID NO: 7776 - protein, 12 aa, Artificial Sequence
  Synthetically generated peptide
CEFCENGACTGC

SEQ ID NO: 7777 - protein, 12 aa, Artificial Sequence
  Synthetically generated peptide
CEFCENGACTAC

SEQ ID NO: 7778 - protein, 12 aa, Artificial Sequence
  Synthetically generated peptide
CEFCENGACVGC

SEQ ID NO: 7779 - protein, 12 aa, Artificial Sequence
  Synthetically generated peptide
CEFCENGACVAC

SEQ ID NO: 7780 - protein, 12 aa, Artificial Sequence
  Synthetically generated peptide
CEFCENGACGGC

SEQ ID NO: 7781 - protein, 12 aa, Artificial Sequence
  Synthetically generated peptide
CEFCENGACGAC

SEQ ID NO: 7782 - protein, 12 aa, Artificial Sequence
  Synthetically generated peptide
CEFCENGTCTGC

SEQ ID NO: 7783 - protein, 12 aa, Artificial Sequence
  Synthetically generated peptide
CEFCENGTCTAC

SEQ ID NO: 7784 - protein, 12 aa, Artificial Sequence
  Synthetically generated peptide
CEFCENGTCVGC

SEQ ID NO: 7785 - protein, 12 aa, Artificial Sequence
  Synthetically generated peptide
CEFCENGTCVAC

SEQ ID NO: 7786 - protein, 12 aa, Artificial Sequence
  Synthetically generated peptide
CEFCENGTCGGC

SEQ ID NO: 7787 - protein, 12 aa, Artificial Sequence
  Synthetically generated peptide
CEFCENGTCGAC

SEQ ID NO: 7788 - protein, 12 aa, Artificial Sequence
  Synthetically generated peptide
CEFCGNPACTGC

SEQ ID NO: 7789 - protein, 12 aa, Artificial Sequence
  Synthetically generated peptide
CEFCGNPACTAC

SEQ ID NO: 7790 - protein, 12 aa, Artificial Sequence
  Synthetically generated peptide
CEFCGNPACVGC

SEQ ID NO: 7791 - protein, 12 aa, Artificial Sequence
  Synthetically generated peptide
CEFCGNPACVAC

SEQ ID NO: 7792 - protein, 12 aa, Artificial Sequence
  Synthetically generated peptide
CEFCGNPACGGC

SEQ ID NO: 7793 - protein, 12 aa, Artificial Sequence
  Synthetically generated peptide
CEFCGNPACGAC

SEQ ID NO: 7794 - protein, 12 aa, Artificial Sequence
  Synthetically generated peptide
CEFCGNPTCTGC

SEQ ID NO: 7795 - protein, 12 aa, Artificial Sequence
  Synthetically generated peptide
CEFCGNPTCTAC

SEQ ID NO: 7796 - protein, 12 aa, Artificial Sequence
  Synthetically generated peptide
CEFCGNPTCVGC

SEQ ID NO: 7797 - protein, 12 aa, Artificial Sequence
  Synthetically generated peptide
CEFCGNPTCVAC

SEQ ID NO: 7798 - protein, 12 aa, Artificial Sequence
  Synthetically generated peptide
CEFCGNPTCGGC

SEQ ID NO: 7799 - protein, 12 aa, Artificial Sequence
  Synthetically generated peptide
CEFCGNPTCGAC

SEQ ID NO: 7800 - protein, 12 aa, Artificial Sequence
  Synthetically generated peptide
CEFCGNGACTGC

SEQ ID NO: 7801 - protein, 12 aa, Artificial Sequence
  Synthetically generated peptide
CEFCGNGACTAC

SEQ ID NO: 7802 - protein, 12 aa, Artificial Sequence
  Synthetically generated peptide
CEFCGNGACVGC

SEQ ID NO: 7803 - protein, 12 aa, Artificial Sequence
  Synthetically generated peptide
CEFCGNGACVAC

SEQ ID NO: 7804 - protein, 12 aa, Artificial Sequence
  Synthetically generated peptide
CEFCGNGACGGC

SEQ ID NO: 7805 - protein, 12 aa, Artificial Sequence
  Synthetically generated peptide
CEFCGNGACGAC

SEQ ID NO: 7806 - protein, 12 aa, Artificial Sequence
  Synthetically generated peptide
CEFCGNGTCTGC

SEQ ID NO: 7807 - protein, 12 aa, Artificial Sequence
  Synthetically generated peptide
CEFCGNGTCTAC

SEQ ID NO: 7808 - protein, 12 aa, Artificial Sequence
  Synthetically generated peptide
CEFCGNGTCVGC

SEQ ID NO: 7809 - protein, 12 aa, Artificial Sequence
  Synthetically generated peptide
CEFCGNGTCVAC

SEQ ID NO: 7810 - protein, 12 aa, Artificial Sequence
  Synthetically generated peptide
CEFCGNGTCGGC

SEQ ID NO: 7811 - protein, 12 aa, Artificial Sequence
  Synthetically generated peptide
CEFCGNGTCGAC

SEQ ID NO: 7812 - protein, 12 aa, Artificial Sequence
  Synthetically generated peptide
CEFCHNPACTGC

SEQ ID NO: 7813 - protein, 12 aa, Artificial Sequence
  Synthetically generated peptide
CEFCHNPACTAC

SEQ ID NO: 7814 - protein, 12 aa, Artificial Sequence
  Synthetically generated peptide
CEFCHNPACVGC

SEQ ID NO: 7815 - protein, 12 aa, Artificial Sequence
  Synthetically generated peptide
CEFCHNPACVAC

SEQ ID NO: 7816 - protein, 12 aa, Artificial Sequence
  Synthetically generated peptide
CEFCHNPACGGC

SEQ ID NO: 7817 - protein, 12 aa, Artificial Sequence
  Synthetically generated peptide
CEFCHNPACGAC

SEQ ID NO: 7818 - protein, 12 aa, Artificial Sequence
  Synthetically generated peptide
CEFCHNPTCTGC

SEQ ID NO: 7819 - protein, 12 aa, Artificial Sequence
  Synthetically generated peptide
CEFCHNPTCTAC

SEQ ID NO: 7820 - protein, 12 aa, Artificial Sequence
  Synthetically generated peptide
CEFCHNPTCVGC

SEQ ID NO: 7821 - protein, 12 aa, Artificial Sequence
  Synthetically generated peptide
CEFCHNPTCVAC

SEQ ID NO: 7822 - protein, 12 aa, Artificial Sequence
  Synthetically generated peptide
CEFCHNPTCGGC

SEQ ID NO: 7823 - protein, 12 aa, Artificial Sequence
  Synthetically generated peptide
CEFCHNPTCGAC

SEQ ID NO: 7824 - protein, 12 aa, Artificial Sequence
  Synthetically generated peptide
CEFCHNGACTGC

SEQ ID NO: 7825 - protein, 12 aa, Artificial Sequence
  Synthetically generated peptide
CEFCHNGACTAC

SEQ ID NO: 7826 - protein, 12 aa, Artificial Sequence
  Synthetically generated peptide
CEFCHNGACVGC

SEQ ID NO: 7827 - protein, 12 aa, Artificial Sequence
  Synthetically generated peptide
CEFCHNGACVAC

SEQ ID NO: 7828 - protein, 12 aa, Artificial Sequence
  Synthetically generated peptide
CEFCHNGACGGC

SEQ ID NO: 7829 - protein, 12 aa, Artificial Sequence
  Synthetically generated peptide
CEFCHNGACGAC

SEQ ID NO: 7830 - protein, 12 aa, Artificial Sequence
  Synthetically generated peptide
CEFCHNGTCTGC

SEQ ID NO: 7831 - protein, 12 aa, Artificial Sequence
  Synthetically generated peptide
CEFCHNGTCTAC

SEQ ID NO: 7832 - protein, 12 aa, Artificial Sequence
  Synthetically generated peptide
CEFCHNGTCVGC

SEQ ID NO: 7833 - protein, 12 aa, Artificial Sequence
  Synthetically generated peptide
CEFCHNGTCVAC

SEQ ID NO: 7834 - protein, 12 aa, Artificial Sequence
  Synthetically generated peptide
CEFCHNGTCGGC

SEQ ID NO: 7835 - protein, 12 aa, Artificial Sequence
  Synthetically generated peptide
CEFCHNGTCGAC

SEQ ID NO: 7836 - protein, 12 aa, Artificial Sequence
  Synthetically generated peptide
CEFCINPACTGC

SEQ ID NO: 7837 - protein, 12 aa, Artificial Sequence
  Synthetically generated peptide
CEFCINPACTAC

SEQ ID NO: 7838 - protein, 12 aa, Artificial Sequence
  Synthetically generated peptide
CEFCINPACVGC

SEQ ID NO: 7839 - protein, 12 aa, Artificial Sequence
  Synthetically generated peptide
CEFCINPACVAC

SEQ ID NO: 7840 - protein, 12 aa, Artificial Sequence
  Synthetically generated peptide
CEFCINPACGGC

SEQ ID NO: 7841 - protein, 12 aa, Artificial Sequence
  Synthetically generated peptide
CEFCINPACGAC

SEQ ID NO: 7842 - protein, 12 aa, Artificial Sequence
  Synthetically generated peptide
CEFCINPTCTGC

SEQ ID NO: 7843 - protein, 12 aa, Artificial Sequence
  Synthetically generated peptide
CEFCINPTCTAC

SEQ ID NO: 7844 - protein, 12 aa, Artificial Sequence
  Synthetically generated peptide
CEFCINPTCVGC

SEQ ID NO: 7845 - protein, 12 aa, Artificial Sequence
  Synthetically generated peptide
CEFCINPTCVAC

SEQ ID NO: 7846 - protein, 12 aa, Artificial Sequence
  Synthetically generated peptide
CEFCINPTCGGC

SEQ ID NO: 7847 - protein, 12 aa, Artificial Sequence
  Synthetically generated peptide
CEFCINPTCGAC

SEQ ID NO: 7848 - protein, 12 aa, Artificial Sequence
  Synthetically generated peptide
CEFCINGACTGC

SEQ ID NO: 7849 - protein, 12 aa, Artificial Sequence
  Synthetically generated peptide
CEFCINGACTAC

SEQ ID NO: 7850 - protein, 12 aa, Artificial Sequence
  Synthetically generated peptide
CEFCINGACVGC

SEQ ID NO: 7851 - protein, 12 aa, Artificial Sequence
  Synthetically generated peptide
CEFCINGACVAC

SEQ ID NO: 7852 - protein, 12 aa, Artificial Sequence
  Synthetically generated peptide
CEFCINGACGGC

SEQ ID NO: 7853 - protein, 12 aa, Artificial Sequence
  Synthetically generated peptide
CEFCINGACGAC

SEQ ID NO: 7854 - protein, 12 aa, Artificial Sequence
  Synthetically generated peptide
CEFCINGTCTGC

SEQ ID NO: 7855 - protein, 12 aa, Artificial Sequence
  Synthetically generated peptide
CEFCINGTCTAC

SEQ ID NO: 7856 - protein, 12 aa, Artificial Sequence
  Synthetically generated peptide
CEFCINGTCVGC

SEQ ID NO: 7857 - protein, 12 aa, Artificial Sequence
  Synthetically generated peptide
CEFCINGTCVAC

SEQ ID NO: 7858 - protein, 12 aa, Artificial Sequence
  Synthetically generated peptide
CEFCINGTCGGC

SEQ ID NO: 7859 - protein, 12 aa, Artificial Sequence
  Synthetically generated peptide
CEFCINGTCGAC

SEQ ID NO: 7860 - protein, 12 aa, Artificial Sequence
  Synthetically generated peptide
CEFCLNPACTGC

SEQ ID NO: 7861 - protein, 12 aa, Artificial Sequence
  Synthetically generated peptide
CEFCLNPACTAC

SEQ ID NO: 7862 - protein, 12 aa, Artificial Sequence
  Synthetically generated peptide
CEFCLNPACVGC

SEQ ID NO: 7863 - protein, 12 aa, Artificial Sequence
  Synthetically generated peptide
CEFCLNPACVAC

SEQ ID NO: 7864 - protein, 12 aa, Artificial Sequence
  Synthetically generated peptide
CEFCLNPACGGC

SEQ ID NO: 7865 - protein, 12 aa, Artificial Sequence
  Synthetically generated peptide
CEFCLNPACGAC

SEQ ID NO: 7866 - protein, 12 aa, Artificial Sequence
  Synthetically generated peptide
CEFCLNPTCTGC

SEQ ID NO: 7867 - protein, 12 aa, Artificial Sequence
  Synthetically generated peptide
CEFCLNPTCTAC

SEQ ID NO: 7868 - protein, 12 aa, Artificial Sequence
  Synthetically generated peptide
CEFCLNPTCVGC

SEQ ID NO: 7869 - protein, 12 aa, Artificial Sequence
  Synthetically generated peptide
CEFCLNPTCVAC

SEQ ID NO: 7870 - protein, 12 aa, Artificial Sequence
  Synthetically generated peptide
CEFCLNPTCGGC

SEQ ID NO: 7871 - protein, 12 aa, Artificial Sequence
  Synthetically generated peptide
CEFCLNPTCGAC

SEQ ID NO: 7872 - protein, 12 aa, Artificial Sequence
  Synthetically generated peptide
CEFCLNGACTGC

SEQ ID NO: 7873 - protein, 12 aa, Artificial Sequence
  Synthetically generated peptide
CEFCLNGACTAC

SEQ ID NO: 7874 - protein, 12 aa, Artificial Sequence
  Synthetically generated peptide
CEFCLNGACVGC

SEQ ID NO: 7875 - protein, 12 aa, Artificial Sequence
  Synthetically generated peptide
CEFCLNGACVAC

SEQ ID NO: 7876 - protein, 12 aa, Artificial Sequence
  Synthetically generated peptide
CEFCLNGACGGC

SEQ ID NO: 7877 - protein, 12 aa, Artificial Sequence
  Synthetically generated peptide
CEFCLNGACGAC

SEQ ID NO: 7878 - protein, 12 aa, Artificial Sequence
  Synthetically generated peptide
CEFCLNGTCTGC

SEQ ID NO: 7879 - protein, 12 aa, Artificial Sequence
  Synthetically generated peptide
CEFCLNGTCTAC

SEQ ID NO: 7880 - protein, 12 aa, Artificial Sequence
  Synthetically generated peptide
CEFCLNGTCVGC

SEQ ID NO: 7881 - protein, 12 aa, Artificial Sequence
  Synthetically generated peptide
CEFCLNGTCVAC

SEQ ID NO: 7882 - protein, 12 aa, Artificial Sequence
  Synthetically generated peptide
CEFCLNGTCGGC

SEQ ID NO: 7883 - protein, 12 aa, Artificial Sequence
  Synthetically generated peptide
CEFCLNGTCGAC

SEQ ID NO: 7884 - protein, 12 aa, Artificial Sequence
  Synthetically generated peptide
CEFCKNPACTGC

SEQ ID NO: 7885 - protein, 12 aa, Artificial Sequence
  Synthetically generated peptide
CEFCKNPACTAC

SEQ ID NO: 7886 - protein, 12 aa, Artificial Sequence
  Synthetically generated peptide
CEFCKNPACVGC

SEQ ID NO: 7887 - protein, 12 aa, Artificial Sequence
  Synthetically generated peptide
CEFCKNPACVAC

SEQ ID NO: 7888 - protein, 12 aa, Artificial Sequence
  Synthetically generated peptide
CEFCKNPACGGC

SEQ ID NO: 7889 - protein, 12 aa, Artificial Sequence
  Synthetically generated peptide
CEFCKNPACGAC

SEQ ID NO: 7890 - protein, 12 aa, Artificial Sequence
  Synthetically generated peptide
CEFCKNPTCTGC

SEQ ID NO: 7891 - protein, 12 aa, Artificial Sequence
  Synthetically generated peptide
CEFCKNPTCTAC

SEQ ID NO: 7892 - protein, 12 aa, Artificial Sequence
  Synthetically generated peptide
CEFCKNPTCVGC

SEQ ID NO: 7893 - protein, 12 aa, Artificial Sequence
  Synthetically generated peptide
CEFCKNPTCVAC

SEQ ID NO: 7894 - protein, 12 aa, Artificial Sequence
  Synthetically generated peptide
CEFCKNPTCGGC

SEQ ID NO: 7895 - protein, 12 aa, Artificial Sequence
  Synthetically generated peptide
CEFCKNPTCGAC

SEQ ID NO: 7896 - protein, 12 aa, Artificial Sequence
  Synthetically generated peptide
CEFCKNGACTGC

SEQ ID NO: 7897 - protein, 12 aa, Artificial Sequence
  Synthetically generated peptide
CEFCKNGACTAC

SEQ ID NO: 7898 - protein, 12 aa, Artificial Sequence
  Synthetically generated peptide
CEFCKNGACVGC

SEQ ID NO: 7899 - protein, 12 aa, Artificial Sequence
  Synthetically generated peptide
CEFCKNGACVAC

SEQ ID NO: 7900 - protein, 12 aa, Artificial Sequence
  Synthetically generated peptide
CEFCKNGACGGC

SEQ ID NO: 7901 - protein, 12 aa, Artificial Sequence
  Synthetically generated peptide
CEFCKNGACGAC

SEQ ID NO: 7902 - protein, 12 aa, Artificial Sequence
  Synthetically generated peptide
CEFCKNGTCTGC

SEQ ID NO: 7903 - protein, 12 aa, Artificial Sequence
  Synthetically generated peptide
CEFCKNGTCTAC

SEQ ID NO: 7904 - protein, 12 aa, Artificial Sequence
  Synthetically generated peptide
CEFCKNGTCVGC

SEQ ID NO: 7905 - protein, 12 aa, Artificial Sequence
  Synthetically generated peptide
CEFCKNGTCVAC

SEQ ID NO: 7906 - protein, 12 aa, Artificial Sequence
  Synthetically generated peptide
CEFCKNGTCGGC

SEQ ID NO: 7907 - protein, 12 aa, Artificial Sequence
  Synthetically generated peptide
CEFCKNGTCGAC

SEQ ID NO: 7908 - protein, 12 aa, Artificial Sequence
  Synthetically generated peptide
CEFCMNPACTGC

SEQ ID NO: 7909 - protein, 12 aa, Artificial Sequence
  Synthetically generated peptide
CEFCMNPACTAC

SEQ ID NO: 7910 - protein, 12 aa, Artificial Sequence
  Synthetically generated peptide
CEFCMNPACVGC

SEQ ID NO: 7911 - protein, 12 aa, Artificial Sequence
  Synthetically generated peptide
CEFCMNPACVAC

SEQ ID NO: 7912 - protein, 12 aa, Artificial Sequence
  Synthetically generated peptide
CEFCMNPACGGC

SEQ ID NO: 7913 - protein, 12 aa, Artificial Sequence
  Synthetically generated peptide
CEFCMNPACGAC

SEQ ID NO: 7914 - protein, 12 aa, Artificial Sequence
  Synthetically generated peptide
CEFCMNPTCTGC

SEQ ID NO: 7915 - protein, 12 aa, Artificial Sequence
  Synthetically generated peptide
CEFCMNPTCTAC

SEQ ID NO: 7916 - protein, 12 aa, Artificial Sequence
  Synthetically generated peptide
CEFCMNPTCVGC

SEQ ID NO: 7917 - protein, 12 aa, Artificial Sequence
  Synthetically generated peptide
CEFCMNPTCVAC

SEQ ID NO: 7918 - protein, 12 aa, Artificial Sequence
  Synthetically generated peptide
CEFCMNPTCGGC

SEQ ID NO: 7919 - protein, 12 aa, Artificial Sequence
  Synthetically generated peptide
CEFCMNPTCGAC

SEQ ID NO: 7920 - protein, 12 aa, Artificial Sequence
  Synthetically generated peptide
CEFCMNGACTGC

SEQ ID NO: 7921 - protein, 12 aa, Artificial Sequence
  Synthetically generated peptide
CEFCMNGACTAC

SEQ ID NO: 7922 - protein, 12 aa, Artificial Sequence
  Synthetically generated peptide
CEFCMNGACVGC

SEQ ID NO: 7923 - protein, 12 aa, Artificial Sequence
  Synthetically generated peptide
CEFCMNGACVAC

SEQ ID NO: 7924 - protein, 12 aa, Artificial Sequence
  Synthetically generated peptide
CEFCMNGACGGC

SEQ ID NO: 7925 - protein, 12 aa, Artificial Sequence
  Synthetically generated peptide
CEFCMNGACGAC

SEQ ID NO: 7926 - protein, 12 aa, Artificial Sequence
  Synthetically generated peptide
CEFCMNGTCTGC

SEQ ID NO: 7927 - protein, 12 aa, Artificial Sequence
  Synthetically generated peptide
CEFCMNGTCTAC

SEQ ID NO: 7928 - protein, 12 aa, Artificial Sequence
  Synthetically generated peptide
CEFCMNGTCVGC

SEQ ID NO: 7929 - protein, 12 aa, Artificial Sequence
  Synthetically generated peptide
CEFCMNGTCVAC

SEQ ID NO: 7930 - protein, 12 aa, Artificial Sequence
  Synthetically generated peptide
CEFCMNGTCGGC

SEQ ID NO: 7931 - protein, 12 aa, Artificial Sequence
  Synthetically generated peptide
CEFCMNGTCGAC

SEQ ID NO: 7932 - protein, 12 aa, Artificial Sequence
  Synthetically generated peptide
CEFCFNPACTGC

SEQ ID NO: 7933 - protein, 12 aa, Artificial Sequence
  Synthetically generated peptide
CEFCFNPACTAC

SEQ ID NO: 7934 - protein, 12 aa, Artificial Sequence
  Synthetically generated peptide
CEFCFNPACVGC

SEQ ID NO: 7935 - protein, 12 aa, Artificial Sequence
  Synthetically generated peptide
CEFCFNPACVAC

SEQ ID NO: 7936 - protein, 12 aa, Artificial Sequence
  Synthetically generated peptide
CEFCFNPACGGC

SEQ ID NO: 7937 - protein, 12 aa, Artificial Sequence
  Synthetically generated peptide
CEFCFNPACGAC

SEQ ID NO: 7938 - protein, 12 aa, Artificial Sequence
  Synthetically generated peptide
CEFCFNPTCTGC

SEQ ID NO: 7939 - protein, 12 aa, Artificial Sequence
  Synthetically generated peptide
CEFCFNPTCTAC

SEQ ID NO: 7940 - protein, 12 aa, Artificial Sequence
  Synthetically generated peptide
CEFCFNPTCVGC

SEQ ID NO: 7941 - protein, 12 aa, Artificial Sequence
  Synthetically generated peptide
CEFCFNPTCVAC

SEQ ID NO: 7942 - protein, 12 aa, Artificial Sequence
  Synthetically generated peptide
CEFCFNPTCGGC

SEQ ID NO: 7943 - protein, 12 aa, Artificial Sequence
  Synthetically generated peptide
CEFCFNPTCGAC

SEQ ID NO: 7944 - protein, 12 aa, Artificial Sequence
  Synthetically generated peptide
CEFCFNGACTGC

SEQ ID NO: 7945 - protein, 12 aa, Artificial Sequence
  Synthetically generated peptide
CEFCFNGACTAC

SEQ ID NO: 7946 - protein, 12 aa, Artificial Sequence
  Synthetically generated peptide
CEFCFNGACVGC

SEQ ID NO: 7947 - protein, 12 aa, Artificial Sequence
  Synthetically generated peptide
CEFCFNGACVAC

SEQ ID NO: 7948 - protein, 12 aa, Artificial Sequence
  Synthetically generated peptide
CEFCFNGACGGC

SEQ ID NO: 7949 - protein, 12 aa, Artificial Sequence
  Synthetically generated peptide
CEFCFNGACGAC

SEQ ID NO: 7950 - protein, 12 aa, Artificial Sequence
  Synthetically generated peptide
CEFCFNGTCTGC

SEQ ID NO: 7951 - protein, 12 aa, Artificial Sequence
  Synthetically generated peptide
CEFCFNGTCTAC

SEQ ID NO: 7952 - protein, 12 aa, Artificial Sequence
  Synthetically generated peptide
CEFCFNGTCVGC

SEQ ID NO: 7953 - protein, 12 aa, Artificial Sequence
  Synthetically generated peptide
CEFCFNGTCVAC

SEQ ID NO: 7954 - protein, 12 aa, Artificial Sequence
  Synthetically generated peptide
CEFCFNGTCGGC

SEQ ID NO: 7955 - protein, 12 aa, Artificial Sequence
  Synthetically generated peptide
CEFCFNGTCGAC

SEQ ID NO: 7956 - protein, 12 aa, Artificial Sequence
  Synthetically generated peptide
CEFCPNPACTGC

SEQ ID NO: 7957 - protein, 12 aa, Artificial Sequence
  Synthetically generated peptide
CEFCPNPACTAC

SEQ ID NO: 7958 - protein, 12 aa, Artificial Sequence
  Synthetically generated peptide
CEFCPNPACVGC

SEQ ID NO: 7959 - protein, 12 aa, Artificial Sequence
  Synthetically generated peptide
CEFCPNPACVAC

SEQ ID NO: 7960 - protein, 12 aa, Artificial Sequence
  Synthetically generated peptide
CEFCPNPACGGC

SEQ ID NO: 7961 - protein, 12 aa, Artificial Sequence
  Synthetically generated peptide
CEFCPNPACGAC

SEQ ID NO: 7962 - protein, 12 aa, Artificial Sequence
  Synthetically generated peptide
CEFCPNPTCTGC

SEQ ID NO: 7963 - protein, 12 aa, Artificial Sequence
  Synthetically generated peptide
CEFCPNPTCTAC

SEQ ID NO: 7964 - protein, 12 aa, Artificial Sequence
  Synthetically generated peptide
CEFCPNPTCVGC

SEQ ID NO: 7965 - protein, 12 aa, Artificial Sequence
  Synthetically generated peptide
CEFCPNPTCVAC

SEQ ID NO: 7966 - protein, 12 aa, Artificial Sequence
  Synthetically generated peptide
CEFCPNPTCGGC

SEQ ID NO: 7967 - protein, 12 aa, Artificial Sequence
  Synthetically generated peptide
CEFCPNPTCGAC

SEQ ID NO: 7968 - protein, 12 aa, Artificial Sequence
  Synthetically generated peptide
CEFCPNGACTGC

SEQ ID NO: 7969 - protein, 12 aa, Artificial Sequence
  Synthetically generated peptide
CEFCPNGACTAC

SEQ ID NO: 7970 - protein, 12 aa, Artificial Sequence
  Synthetically generated peptide
CEFCPNGACVGC

SEQ ID NO: 7971 - protein, 12 aa, Artificial Sequence
  Synthetically generated peptide
CEFCPNGACVAC

SEQ ID NO: 7972 - protein, 12 aa, Artificial Sequence
  Synthetically generated peptide
CEFCPNGACGGC

SEQ ID NO: 7973 - protein, 12 aa, Artificial Sequence
  Synthetically generated peptide
CEFCPNGACGAC

SEQ ID NO: 7974 - protein, 12 aa, Artificial Sequence
  Synthetically generated peptide
CEFCPNGTCTGC

SEQ ID NO: 7975 - protein, 12 aa, Artificial Sequence
  Synthetically generated peptide
CEFCPNGTCTAC

SEQ ID NO: 7976 - protein, 12 aa, Artificial Sequence
  Synthetically generated peptide
CEFCPNGTCVGC

SEQ ID NO: 7977 - protein, 12 aa, Artificial Sequence
  Synthetically generated peptide
CEFCPNGTCVAC

SEQ ID NO: 7978 - protein, 12 aa, Artificial Sequence
  Synthetically generated peptide
CEFCPNGTCGGC

SEQ ID NO: 7979 - protein, 12 aa, Artificial Sequence
  Synthetically generated peptide
CEFCPNGTCGAC

SEQ ID NO: 7980 - protein, 12 aa, Artificial Sequence
  Synthetically generated peptide
CEFCSNPACTGC

SEQ ID NO: 7981 - protein, 12 aa, Artificial Sequence
  Synthetically generated peptide
CEFCSNPACTAC

SEQ ID NO: 7982 - protein, 12 aa, Artificial Sequence
  Synthetically generated peptide
CEFCSNPACVGC

SEQ ID NO: 7983 - protein, 12 aa, Artificial Sequence
  Synthetically generated peptide
CEFCSNPACVAC

SEQ ID NO: 7984 - protein, 12 aa, Artificial Sequence
  Synthetically generated peptide
CEFCSNPACGGC

SEQ ID NO: 7985 - protein, 12 aa, Artificial Sequence
  Synthetically generated peptide
CEFCSNPACGAC

SEQ ID NO: 7986 - protein, 12 aa, Artificial Sequence
  Synthetically generated peptide
CEFCSNPTCTGC

SEQ ID NO: 7987 - protein, 12 aa, Artificial Sequence
  Synthetically generated peptide
CEFCSNPTCTAC

SEQ ID NO: 7988 - protein, 12 aa, Artificial Sequence
  Synthetically generated peptide
CEFCSNPTCVGC

SEQ ID NO: 7989 - protein, 12 aa, Artificial Sequence
  Synthetically generated peptide
CEFCSNPTCVAC

SEQ ID NO: 7990 - protein, 12 aa, Artificial Sequence
  Synthetically generated peptide
CEFCSNPTCGGC

SEQ ID NO: 7991 - protein, 12 aa, Artificial Sequence
  Synthetically generated peptide
CEFCSNPTCGAC

SEQ ID NO: 7992 - protein, 12 aa, Artificial Sequence
  Synthetically generated peptide
CEFCSNGACTGC

SEQ ID NO: 7993 - protein, 12 aa, Artificial Sequence
  Synthetically generated peptide
CEFCSNGACTAC

SEQ ID NO: 7994 - protein, 12 aa, Artificial Sequence
  Synthetically generated peptide
CEFCSNGACVGC

SEQ ID NO: 7995 - protein, 12 aa, Artificial Sequence
  Synthetically generated peptide
CEFCSNGACVAC

SEQ ID NO: 7996 - protein, 12 aa, Artificial Sequence
  Synthetically generated peptide
CEFCSNGACGGC

SEQ ID NO: 7997 - protein, 12 aa, Artificial Sequence
  Synthetically generated peptide
CEFCSNGACGAC

SEQ ID NO: 7998 - protein, 12 aa, Artificial Sequence
  Synthetically generated peptide
CEFCSNGTCTGC

SEQ ID NO: 7999 - protein, 12 aa, Artificial Sequence
  Synthetically generated peptide
CEFCSNGTCTAC

SEQ ID NO: 8000 - protein, 12 aa, Artificial Sequence
  Synthetically generated peptide
CEFCSNGTCVGC

SEQ ID NO: 8001 - protein, 12 aa, Artificial Sequence
  Synthetically generated peptide
CEFCSNGTCVAC

SEQ ID NO: 8002 - protein, 12 aa, Artificial Sequence
  Synthetically generated peptide
CEFCSNGTCGGC

SEQ ID NO: 8003 - protein, 12 aa, Artificial Sequence
  Synthetically generated peptide
CEFCSNGTCGAC

SEQ ID NO: 8004 - protein, 12 aa, Artificial Sequence
  Synthetically generated peptide
CEFCTNPACTGC

SEQ ID NO: 8005 - protein, 12 aa, Artificial Sequence
  Synthetically generated peptide
CEFCTNPACTAC

SEQ ID NO: 8006 - protein, 12 aa, Artificial Sequence
  Synthetically generated peptide
CEFCTNPACVGC

SEQ ID NO: 8007 - protein, 12 aa, Artificial Sequence
  Synthetically generated peptide
CEFCTNPACVAC

SEQ ID NO: 8008 - protein, 12 aa, Artificial Sequence
  Synthetically generated peptide
CEFCTNPACGGC

SEQ ID NO: 8009 - protein, 12 aa, Artificial Sequence
  Synthetically generated peptide
CEFCTNPACGAC

SEQ ID NO: 8010 - protein, 12 aa, Artificial Sequence
  Synthetically generated peptide
CEFCTNPTCTGC

SEQ ID NO: 8011 - protein, 12 aa, Artificial Sequence
  Synthetically generated peptide
CEFCTNPTCTAC

SEQ ID NO: 8012 - protein, 12 aa, Artificial Sequence
  Synthetically generated peptide
CEFCTNPTCVGC

SEQ ID NO: 8013 - protein, 12 aa, Artificial Sequence
  Synthetically generated peptide
CEFCTNPTCVAC

SEQ ID NO: 8014 - protein, 12 aa, Artificial Sequence
  Synthetically generated peptide
CEFCTNPTCGGC

SEQ ID NO: 8015 - protein, 12 aa, Artificial Sequence
  Synthetically generated peptide
CEFCTNPTCGAC

SEQ ID NO: 8016 - protein, 12 aa, Artificial Sequence
  Synthetically generated peptide
CEFCTNGACTGC

SEQ ID NO: 8017 - protein, 12 aa, Artificial Sequence
  Synthetically generated peptide
CEFCTNGACTAC

SEQ ID NO: 8018 - protein, 12 aa, Artificial Sequence
  Synthetically generated peptide
CEFCTNGACVGC

SEQ ID NO: 8019 - protein, 12 aa, Artificial Sequence
  Synthetically generated peptide
CEFCTNGACVAC

SEQ ID NO: 8020 - protein, 12 aa, Artificial Sequence
  Synthetically generated peptide
CEFCTNGACGGC

SEQ ID NO: 8021 - protein, 12 aa, Artificial Sequence
  Synthetically generated peptide
CEFCTNGACGAC

SEQ ID NO: 8022 - protein, 12 aa, Artificial Sequence
  Synthetically generated peptide
CEFCTNGTCTGC

SEQ ID NO: 8023 - protein, 12 aa, Artificial Sequence
  Synthetically generated peptide
CEFCTNGTCTAC

SEQ ID NO: 8024 - protein, 12 aa, Artificial Sequence
  Synthetically generated peptide
CEFCTNGTCVGC

SEQ ID NO: 8025 - protein, 12 aa, Artificial Sequence
  Synthetically generated peptide
CEFCTNGTCVAC

SEQ ID NO: 8026 - protein, 12 aa, Artificial Sequence
  Synthetically generated peptide
CEFCTNGTCGGC

SEQ ID NO: 8027 - protein, 12 aa, Artificial Sequence
  Synthetically generated peptide
CEFCTNGTCGAC

SEQ ID NO: 8028 - protein, 12 aa, Artificial Sequence
  Synthetically generated peptide
CEFCWNPACTGC

SEQ ID NO: 8029 - protein, 12 aa, Artificial Sequence
  Synthetically generated peptide
CEFCWNPACTAC

SEQ ID NO: 8030 - protein, 12 aa, Artificial Sequence
  Synthetically generated peptide
CEFCWNPACVGC

SEQ ID NO: 8031 - protein, 12 aa, Artificial Sequence
  Synthetically generated peptide
CEFCWNPACVAC

SEQ ID NO: 8032 - protein, 12 aa, Artificial Sequence
  Synthetically generated peptide
CEFCWNPACGGC

SEQ ID NO: 8033 - protein, 12 aa, Artificial Sequence
  Synthetically generated peptide
CEFCWNPACGAC

SEQ ID NO: 8034 - protein, 12 aa, Artificial Sequence
  Synthetically generated peptide
CEFCWNPTCTGC

SEQ ID NO: 8035 - protein, 12 aa, Artificial Sequence
  Synthetically generated peptide
CEFCWNPTCTAC

SEQ ID NO: 8036 - protein, 12 aa, Artificial Sequence
  Synthetically generated peptide
CEFCWNPTCVGC

SEQ ID NO: 8037 - protein, 12 aa, Artificial Sequence
  Synthetically generated peptide
CEFCWNPTCVAC

SEQ ID NO: 8038 - protein, 12 aa, Artificial Sequence
  Synthetically generated peptide
CEFCWNPTCGGC

SEQ ID NO: 8039 - protein, 12 aa, Artificial Sequence
  Synthetically generated peptide
CEFCWNPTCGAC

SEQ ID NO: 8040 - protein, 12 aa, Artificial Sequence
  Synthetically generated peptide
CEFCWNGACTGC

SEQ ID NO: 8041 - protein, 12 aa, Artificial Sequence
  Synthetically generated peptide
CEFCWNGACTAC

SEQ ID NO: 8042 - protein, 12 aa, Artificial Sequence
  Synthetically generated peptide
CEFCWNGACVGC

SEQ ID NO: 8043 - protein, 12 aa, Artificial Sequence
  Synthetically generated peptide
CEFCWNGACVAC

SEQ ID NO: 8044 - protein, 12 aa, Artificial Sequence
  Synthetically generated peptide
CEFCWNGACGGC

SEQ ID NO: 8045 - protein, 12 aa, Artificial Sequence
  Synthetically generated peptide
CEFCWNGACGAC

SEQ ID NO: 8046 - protein, 12 aa, Artificial Sequence
  Synthetically generated peptide
CEFCWNGTCTGC

SEQ ID NO: 8047 - protein, 12 aa, Artificial Sequence
  Synthetically generated peptide
CEFCWNGTCTAC

SEQ ID NO: 8048 - protein, 12 aa, Artificial Sequence
  Synthetically generated peptide
CEFCWNGTCVGC

SEQ ID NO: 8049 - protein, 12 aa, Artificial Sequence
  Synthetically generated peptide
CEFCWNGTCVAC

SEQ ID NO: 8050 - protein, 12 aa, Artificial Sequence
  Synthetically generated peptide
CEFCWNGTCGGC

SEQ ID NO: 8051 - protein, 12 aa, Artificial Sequence
  Synthetically generated peptide
CEFCWNGTCGAC

SEQ ID NO: 8052 - protein, 12 aa, Artificial Sequence
  Synthetically generated peptide
CEFCYNPACTGC

SEQ ID NO: 8053 - protein, 12 aa, Artificial Sequence
  Synthetically generated peptide
CEFCYNPACTAC

SEQ ID NO: 8054 - protein, 12 aa, Artificial Sequence
  Synthetically generated peptide
CEFCYNPACVGC

SEQ ID NO: 8055 - protein, 12 aa, Artificial Sequence
  Synthetically generated peptide
CEFCYNPACVAC

SEQ ID NO: 8056 - protein, 12 aa, Artificial Sequence
  Synthetically generated peptide
CEFCYNPACGGC

SEQ ID NO: 8057 - protein, 12 aa, Artificial Sequence
  Synthetically generated peptide
CEFCYNPACGAC

SEQ ID NO: 8058 - protein, 12 aa, Artificial Sequence
  Synthetically generated peptide
CEFCYNPTCTGC

SEQ ID NO: 8059 - protein, 12 aa, Artificial Sequence
  Synthetically generated peptide
CEFCYNPTCTAC

SEQ ID NO: 8060 - protein, 12 aa, Artificial Sequence
  Synthetically generated peptide
CEFCYNPTCVGC

SEQ ID NO: 8061 - protein, 12 aa, Artificial Sequence
  Synthetically generated peptide
CEFCYNPTCVAC

SEQ ID NO: 8062 - protein, 12 aa, Artificial Sequence
  Synthetically generated peptide
CEFCYNPTCGGC

SEQ ID NO: 8063 - protein, 12 aa, Artificial Sequence
  Synthetically generated peptide
CEFCYNPTCGAC

SEQ ID NO: 8064 - protein, 12 aa, Artificial Sequence
  Synthetically generated peptide
CEFCYNGACTGC

SEQ ID NO: 8065 - protein, 12 aa, Artificial Sequence
  Synthetically generated peptide
CEFCYNGACTAC

SEQ ID NO: 8066 - protein, 12 aa, Artificial Sequence
  Synthetically generated peptide
CEFCYNGACVGC

SEQ ID NO: 8067 - protein, 12 aa, Artificial Sequence
  Synthetically generated peptide
CEFCYNGACVAC

SEQ ID NO: 8068 - protein, 12 aa, Artificial Sequence
  Synthetically generated peptide
CEFCYNGACGGC

SEQ ID NO: 8069 - protein, 12 aa, Artificial Sequence
  Synthetically generated peptide
CEFCYNGACGAC

SEQ ID NO: 8070 - protein, 12 aa, Artificial Sequence
  Synthetically generated peptide
CEFCYNGTCTGC

SEQ ID NO: 8071 - protein, 12 aa, Artificial Sequence
  Synthetically generated peptide
CEFCYNGTCTAC

SEQ ID NO: 8072 - protein, 12 aa, Artificial Sequence
  Synthetically generated peptide
CEFCYNGTCVGC

SEQ ID NO: 8073 - protein, 12 aa, Artificial Sequence
  Synthetically generated peptide
CEFCYNGTCVAC

SEQ ID NO: 8074 - protein, 12 aa, Artificial Sequence
  Synthetically generated peptide
CEFCYNGTCGGC

SEQ ID NO: 8075 - protein, 12 aa, Artificial Sequence
  Synthetically generated peptide
CEFCYNGTCGAC

SEQ ID NO: 8076 - protein, 12 aa, Artificial Sequence
  Synthetically generated peptide
CEFCVNPACTGC

SEQ ID NO: 8077 - protein, 12 aa, Artificial Sequence
  Synthetically generated peptide
CEFCVNPACTAC

SEQ ID NO: 8078 - protein, 12 aa, Artificial Sequence
  Synthetically generated peptide
CEFCVNPACVGC

SEQ ID NO: 8079 - protein, 12 aa, Artificial Sequence
  Synthetically generated peptide
CEFCVNPACVAC

SEQ ID NO: 8080 - protein, 12 aa, Artificial Sequence
  Synthetically generated peptide
CEFCVNPACGGC

SEQ ID NO: 8081 - protein, 12 aa, Artificial Sequence
  Synthetically generated peptide
CEFCVNPACGAC

SEQ ID NO: 8082 - protein, 12 aa, Artificial Sequence
  Synthetically generated peptide
CEFCVNPTCTGC

SEQ ID NO: 8083 - protein, 12 aa, Artificial Sequence
  Synthetically generated peptide
CEFCVNPTCTAC

SEQ ID NO: 8084 - protein, 12 aa, Artificial Sequence
  Synthetically generated peptide
CEFCVNPTCVGC

SEQ ID NO: 8085 - protein, 12 aa, Artificial Sequence
  Synthetically generated peptide
CEFCVNPTCVAC

SEQ ID NO: 8086 - protein, 12 aa, Artificial Sequence
  Synthetically generated peptide
CEFCVNPTCGGC

SEQ ID NO: 8087 - protein, 12 aa, Artificial Sequence
  Synthetically generated peptide
CEFCVNPTCGAC

SEQ ID NO: 8088 - protein, 12 aa, Artificial Sequence
  Synthetically generated peptide
CEFCVNGACTGC

SEQ ID NO: 8089 - protein, 12 aa, Artificial Sequence
  Synthetically generated peptide
CEFCVNGACTAC

SEQ ID NO: 8090 - protein, 12 aa, Artificial Sequence
  Synthetically generated peptide
CEFCVNGACVGC

SEQ ID NO: 8091 - protein, 12 aa, Artificial Sequence
  Synthetically generated peptide
CEFCVNGACVAC

SEQ ID NO: 8092 - protein, 12 aa, Artificial Sequence
  Synthetically generated peptide
CEFCVNGACGGC

SEQ ID NO: 8093 - protein, 12 aa, Artificial Sequence
  Synthetically generated peptide
CEFCVNGACGAC

SEQ ID NO: 8094 - protein, 12 aa, Artificial Sequence
  Synthetically generated peptide
CEFCVNGTCTGC

SEQ ID NO: 8095 - protein, 12 aa, Artificial Sequence
  Synthetically generated peptide
CEFCVNGTCTAC

SEQ ID NO: 8096 - protein, 12 aa, Artificial Sequence
  Synthetically generated peptide
CEFCVNGTCVGC

SEQ ID NO: 8097 - protein, 12 aa, Artificial Sequence
  Synthetically generated peptide
CEFCVNGTCVAC

SEQ ID NO: 8098 - protein, 12 aa, Artificial Sequence
  Synthetically generated peptide
CEFCVNGTCGGC

SEQ ID NO: 8099 - protein, 12 aa, Artificial Sequence
  Synthetically generated peptide
CEFCVNGTCGAC

SEQ ID NO: 8100 - protein, 11 aa, Artificial Sequence
  Synthetically generated peptide
CEFCNPACTGC

SEQ ID NO: 8101 - protein, 11 aa, Artificial Sequence
  Synthetically generated peptide
CEFCNPACTAC

SEQ ID NO: 8102 - protein, 11 aa, Artificial Sequence
  Synthetically generated peptide
CEFCNPACVGC

SEQ ID NO: 8103 - protein, 11 aa, Artificial Sequence
  Synthetically generated peptide
CEFCNPACVAC

SEQ ID NO: 8104 - protein, 11 aa, Artificial Sequence
  Synthetically generated peptide
CEFCNPACGGC

SEQ ID NO: 8105 - protein, 11 aa, Artificial Sequence
  Synthetically generated peptide
CEFCNPACGAC

SEQ ID NO: 8106 - protein, 11 aa, Artificial Sequence
  Synthetically generated peptide
CEFCNPTCTGC

SEQ ID NO: 8107 - protein, 11 aa, Artificial Sequence
  Synthetically generated peptide
CEFCNPTCTAC

SEQ ID NO: 8108 - protein, 11 aa, Artificial Sequence
  Synthetically generated peptide
CEFCNPTCVGC

SEQ ID NO: 8109 - protein, 11 aa, Artificial Sequence
  Synthetically generated peptide
CEFCNPTCVAC

SEQ ID NO: 8110 - protein, 11 aa, Artificial Sequence
  Synthetically generated peptide
CEFCNPTCGGC

SEQ ID NO: 8111 - protein, 11 aa, Artificial Sequence
  Synthetically generated peptide
CEFCNPTCGAC

SEQ ID NO: 8112 - protein, 11 aa, Artificial Sequence
  Synthetically generated peptide
CEFCNGACTGC

SEQ ID NO: 8113 - protein, 11 aa, Artificial Sequence
  Synthetically generated peptide
CEFCNGACTAC

SEQ ID NO: 8114 - protein, 11 aa, Artificial Sequence
  Synthetically generated peptide
CEFCNGACVGC

SEQ ID NO: 8115 - protein, 11 aa, Artificial Sequence
  Synthetically generated peptide
CEFCNGACVAC

SEQ ID NO: 8116 - protein, 11 aa, Artificial Sequence
  Synthetically generated peptide
CEFCNGACGGC

SEQ ID NO: 8117 - protein, 11 aa, Artificial Sequence
  Synthetically generated peptide
CEFCNGACGAC

SEQ ID NO: 8118 - protein, 11 aa, Artificial Sequence
  Synthetically generated peptide
CEFCNGTCTGC

SEQ ID NO: 8119 - protein, 11 aa, Artificial Sequence
  Synthetically generated peptide
CEFCNGTCTAC

SEQ ID NO: 8120 - protein, 11 aa, Artificial Sequence
  Synthetically generated peptide
CEFCNGTCVGC

SEQ ID NO: 8121 - protein, 11 aa, Artificial Sequence
  Synthetically generated peptide
CEFCNGTCVAC

SEQ ID NO: 8122 - protein, 11 aa, Artificial Sequence
  Synthetically generated peptide
CEFCNGTCGGC

SEQ ID NO: 8123 - protein, 11 aa, Artificial Sequence
  Synthetically generated peptide
CEFCNGTCGAC

SEQ ID NO: 8124 - protein, 12 aa, Artificial Sequence
  Synthetically generated peptide
CELCANPACTGC

SEQ ID NO: 8125 - protein, 12 aa, Artificial Sequence
  Synthetically generated peptide
CELCANPACTAC

SEQ ID NO: 8126 - protein, 12 aa, Artificial Sequence
  Synthetically generated peptide
CELCANPACVGC

SEQ ID NO: 8127 - protein, 12 aa, Artificial Sequence
  Synthetically generated peptide
CELCANPACVAC

SEQ ID NO: 8128 - protein, 12 aa, Artificial Sequence
  Synthetically generated peptide
CELCANPACGGC

SEQ ID NO: 8129 - protein, 12 aa, Artificial Sequence
  Synthetically generated peptide
CELCANPACGAC

SEQ ID NO: 8130 - protein, 12 aa, Artificial Sequence
  Synthetically generated peptide
CELCANPTCTGC

SEQ ID NO: 8131 - protein, 12 aa, Artificial Sequence
  Synthetically generated peptide
CELCANPTCTAC

SEQ ID NO: 8132 - protein, 12 aa, Artificial Sequence
  Synthetically generated peptide
CELCANPTCVGC

SEQ ID NO: 8133 - protein, 12 aa, Artificial Sequence
  Synthetically generated peptide
CELCANPTCVAC

SEQ ID NO: 8134 - protein, 12 aa, Artificial Sequence
  Synthetically generated peptide
CELCANPTCGGC

SEQ ID NO: 8135 - protein, 12 aa, Artificial Sequence
  Synthetically generated peptide
CELCANPTCGAC

SEQ ID NO: 8136 - protein, 12 aa, Artificial Sequence
  Synthetically generated peptide
CELCANGACTGC

SEQ ID NO: 8137 - protein, 12 aa, Artificial Sequence
  Synthetically generated peptide
CELCANGACTAC

SEQ ID NO: 8138 - protein, 12 aa, Artificial Sequence
  Synthetically generated peptide
CELCANGACVGC

SEQ ID NO: 8139 - protein, 12 aa, Artificial Sequence
  Synthetically generated peptide
CELCANGACVAC

SEQ ID NO: 8140 - protein, 12 aa, Artificial Sequence
  Synthetically generated peptide
CELCANGACGGC

SEQ ID NO: 8141 - protein, 12 aa, Artificial Sequence
  Synthetically generated peptide
CELCANGACGAC

SEQ ID NO: 8142 - protein, 12 aa, Artificial Sequence
  Synthetically generated peptide
CELCANGTCTGC

SEQ ID NO: 8143 - protein, 12 aa, Artificial Sequence
  Synthetically generated peptide
CELCANGTCTAC

SEQ ID NO: 8144 - protein, 12 aa, Artificial Sequence
  Synthetically generated peptide
CELCANGTCVGC

SEQ ID NO: 8145 - protein, 12 aa, Artificial Sequence
  Synthetically generated peptide
CELCANGTCVAC

SEQ ID NO: 8146 - protein, 12 aa, Artificial Sequence
  Synthetically generated peptide
CELCANGTCGGC

SEQ ID NO: 8147 - protein, 12 aa, Artificial Sequence
  Synthetically generated peptide
CELCANGTCGAC

SEQ ID NO: 8148 - protein, 12 aa, Artificial Sequence
  Synthetically generated peptide
CELCRNPACTGC

SEQ ID NO: 8149 - protein, 12 aa, Artificial Sequence
  Synthetically generated peptide
CELCRNPACTAC

SEQ ID NO: 8150 - protein, 12 aa, Artificial Sequence
  Synthetically generated peptide
CELCRNPACVGC

SEQ ID NO: 8151 - protein, 12 aa, Artificial Sequence
  Synthetically generated peptide
CELCRNPACVAC

SEQ ID NO: 8152 - protein, 12 aa, Artificial Sequence
  Synthetically generated peptide
CELCRNPACGGC

SEQ ID NO: 8153 - protein, 12 aa, Artificial Sequence
  Synthetically generated peptide
CELCRNPACGAC

SEQ ID NO: 8154 - protein, 12 aa, Artificial Sequence
  Synthetically generated peptide
CELCRNPTCTGC

SEQ ID NO: 8155 - protein, 12 aa, Artificial Sequence
  Synthetically generated peptide
CELCRNPTCTAC

SEQ ID NO: 8156 - protein, 12 aa, Artificial Sequence
  Synthetically generated peptide
CELCRNPTCVGC

SEQ ID NO: 8157 - protein, 12 aa, Artificial Sequence
  Synthetically generated peptide
CELCRNPTCVAC

SEQ ID NO: 8158 - protein, 12 aa, Artificial Sequence
  Synthetically generated peptide
CELCRNPTCGGC

SEQ ID NO: 8159 - protein, 12 aa, Artificial Sequence
  Synthetically generated peptide
CELCRNPTCGAC

SEQ ID NO: 8160 - protein, 12 aa, Artificial Sequence
  Synthetically generated peptide
CELCRNGACTGC

SEQ ID NO: 8161 - protein, 12 aa, Artificial Sequence
  Synthetically generated peptide
CELCRNGACTAC

SEQ ID NO: 8162 - protein, 12 aa, Artificial Sequence
  Synthetically generated peptide
CELCRNGACVGC

SEQ ID NO: 8163 - protein, 12 aa, Artificial Sequence
  Synthetically generated peptide
CELCRNGACVAC

SEQ ID NO: 8164 - protein, 12 aa, Artificial Sequence
  Synthetically generated peptide
CELCRNGACGGC

SEQ ID NO: 8165 - protein, 12 aa, Artificial Sequence
  Synthetically generated peptide
CELCRNGACGAC

SEQ ID NO: 8166 - protein, 12 aa, Artificial Sequence
  Synthetically generated peptide
CELCRNGTCTGC

SEQ ID NO: 8167 - protein, 12 aa, Artificial Sequence
  Synthetically generated peptide
CELCRNGTCTAC

SEQ ID NO: 8168 - protein, 12 aa, Artificial Sequence
  Synthetically generated peptide
CELCRNGTCVGC

SEQ ID NO: 8169 - protein, 12 aa, Artificial Sequence
  Synthetically generated peptide
CELCRNGTCVAC

SEQ ID NO: 8170 - protein, 12 aa, Artificial Sequence
  Synthetically generated peptide
CELCRNGTCGGC

SEQ ID NO: 8171 - protein, 12 aa, Artificial Sequence
  Synthetically generated peptide
CELCRNGTCGAC

SEQ ID NO: 8172 - protein, 12 aa, Artificial Sequence
  Synthetically generated peptide
CELCNNPACTGC

SEQ ID NO: 8173 - protein, 12 aa, Artificial Sequence
  Synthetically generated peptide
CELCNNPACTAC

SEQ ID NO: 8174 - protein, 12 aa, Artificial Sequence
  Synthetically generated peptide
CELCNNPACVGC

SEQ ID NO: 8175 - protein, 12 aa, Artificial Sequence
  Synthetically generated peptide
CELCNNPACVAC

SEQ ID NO: 8176 - protein, 12 aa, Artificial Sequence
  Synthetically generated peptide
CELCNNPACGGC

SEQ ID NO: 8177 - protein, 12 aa, Artificial Sequence
  Synthetically generated peptide
CELCNNPACGAC

SEQ ID NO: 8178 - protein, 12 aa, Artificial Sequence
  Synthetically generated peptide
CELCNNPTCTGC

SEQ ID NO: 8179 - protein, 12 aa, Artificial Sequence
  Synthetically generated peptide
CELCNNPTCTAC

SEQ ID NO: 8180 - protein, 12 aa, Artificial Sequence
  Synthetically generated peptide
CELCNNPTCVGC

SEQ ID NO: 8181 - protein, 12 aa, Artificial Sequence
  Synthetically generated peptide
CELCNNPTCVAC

SEQ ID NO: 8182 - protein, 12 aa, Artificial Sequence
  Synthetically generated peptide
CELCNNPTCGGC

SEQ ID NO: 8183 - protein, 12 aa, Artificial Sequence
  Synthetically generated peptide
CELCNNPTCGAC

SEQ ID NO: 8184 - protein, 12 aa, Artificial Sequence
  Synthetically generated peptide
CELCNNGACTGC

SEQ ID NO: 8185 - protein, 12 aa, Artificial Sequence
  Synthetically generated peptide
CELCNNGACTAC

SEQ ID NO: 8186 - protein, 12 aa, Artificial Sequence
  Synthetically generated peptide
CELCNNGACVGC

SEQ ID NO: 8187 - protein, 12 aa, Artificial Sequence
  Synthetically generated peptide
CELCNNGACVAC

SEQ ID NO: 8188 - protein, 12 aa, Artificial Sequence
  Synthetically generated peptide
CELCNNGACGGC

SEQ ID NO: 8189 - protein, 12 aa, Artificial Sequence
  Synthetically generated peptide
CELCNNGACGAC

SEQ ID NO: 8190 - protein, 12 aa, Artificial Sequence
  Synthetically generated peptide
CELCNNGTCTGC

SEQ ID NO: 8191 - protein, 12 aa, Artificial Sequence
  Synthetically generated peptide
CELCNNGTCTAC

SEQ ID NO: 8192 - protein, 12 aa, Artificial Sequence
  Synthetically generated peptide
CELCNNGTCVGC

SEQ ID NO: 8193 - protein, 12 aa, Artificial Sequence
  Synthetically generated peptide
CELCNNGTCVAC

SEQ ID NO: 8194 - protein, 12 aa, Artificial Sequence
  Synthetically generated peptide
CELCNNGTCGGC

SEQ ID NO: 8195 - protein, 12 aa, Artificial Sequence
  Synthetically generated peptide
CELCNNGTCGAC

SEQ ID NO: 8196 - protein, 12 aa, Artificial Sequence
  Synthetically generated peptide
CELCDNPACTGC

SEQ ID NO: 8197 - protein, 12 aa, Artificial Sequence
  Synthetically generated peptide
CELCDNPACTAC

SEQ ID NO: 8198 - protein, 12 aa, Artificial Sequence
  Synthetically generated peptide
CELCDNPACVGC

SEQ ID NO: 8199 - protein, 12 aa, Artificial Sequence
  Synthetically generated peptide
CELCDNPACVAC

SEQ ID NO: 8200 - protein, 12 aa, Artificial Sequence
  Synthetically generated peptide
CELCDNPACGGC

SEQ ID NO: 8201 - protein, 12 aa, Artificial Sequence
  Synthetically generated peptide
CELCDNPACGAC

SEQ ID NO: 8202 - protein, 12 aa, Artificial Sequence
  Synthetically generated peptide
CELCDNPTCTGC

SEQ ID NO: 8203 - protein, 12 aa, Artificial Sequence
  Synthetically generated peptide
CELCDNPTCTAC

SEQ ID NO: 8204 - protein, 12 aa, Artificial Sequence
  Synthetically generated peptide
CELCDNPTCVGC

SEQ ID NO: 8205 - protein, 12 aa, Artificial Sequence
  Synthetically generated peptide
CELCDNPTCVAC

SEQ ID NO: 8206 - protein, 12 aa, Artificial Sequence
  Synthetically generated peptide
CELCDNPTCGGC

SEQ ID NO: 8207 - protein, 12 aa, Artificial Sequence
  Synthetically generated peptide
CELCDNPTCGAC

SEQ ID NO: 8208 - protein, 12 aa, Artificial Sequence
  Synthetically generated peptide
CELCDNGACTGC

SEQ ID NO: 8209 - protein, 12 aa, Artificial Sequence
  Synthetically generated peptide
CELCDNGACTAC

SEQ ID NO: 8210 - protein, 12 aa, Artificial Sequence
  Synthetically generated peptide
CELCDNGACVGC

SEQ ID NO: 8211 - protein, 12 aa, Artificial Sequence
  Synthetically generated peptide
CELCDNGACVAC

SEQ ID NO: 8212 - protein, 12 aa, Artificial Sequence
  Synthetically generated peptide
CELCDNGACGGC

SEQ ID NO: 8213 - protein, 12 aa, Artificial Sequence
  Synthetically generated peptide
CELCDNGACGAC

SEQ ID NO: 8214 - protein, 12 aa, Artificial Sequence
  Synthetically generated peptide
CELCDNGTCTGC

SEQ ID NO: 8215 - protein, 12 aa, Artificial Sequence
  Synthetically generated peptide
CELCDNGTCTAC

SEQ ID NO: 8216 - protein, 12 aa, Artificial Sequence
  Synthetically generated peptide
CELCDNGTCVGC

SEQ ID NO: 8217 - protein, 12 aa, Artificial Sequence
  Synthetically generated peptide
CELCDNGTCVAC

SEQ ID NO: 8218 - protein, 12 aa, Artificial Sequence
  Synthetically generated peptide
CELCDNGTCGGC

SEQ ID NO: 8219 - protein, 12 aa, Artificial Sequence
  Synthetically generated peptide
CELCDNGTCGAC

SEQ ID NO: 8220 - protein, 12 aa, Artificial Sequence
  Synthetically generated peptide
CELCQNPACTGC

SEQ ID NO: 8221 - protein, 12 aa, Artificial Sequence
  Synthetically generated peptide
CELCQNPACTAC

SEQ ID NO: 8222 - protein, 12 aa, Artificial Sequence
  Synthetically generated peptide
CELCQNPACVGC

SEQ ID NO: 8223 - protein, 12 aa, Artificial Sequence
  Synthetically generated peptide
CELCQNPACVAC

SEQ ID NO: 8224 - protein, 12 aa, Artificial Sequence
  Synthetically generated peptide
CELCQNPACGGC

SEQ ID NO: 8225 - protein, 12 aa, Artificial Sequence
  Synthetically generated peptide
CELCQNPACGAC

SEQ ID NO: 8226 - protein, 12 aa, Artificial Sequence
  Synthetically generated peptide
CELCQNPTCTGC

SEQ ID NO: 8227 - protein, 12 aa, Artificial Sequence
  Synthetically generated peptide
CELCQNPTCTAC

SEQ ID NO: 8228 - protein, 12 aa, Artificial Sequence
  Synthetically generated peptide
CELCQNPTCVGC

SEQ ID NO: 8229 - protein, 12 aa, Artificial Sequence
  Synthetically generated peptide
CELCQNPTCVAC

SEQ ID NO: 8230 - protein, 12 aa, Artificial Sequence
  Synthetically generated peptide
CELCQNPTCGGC

SEQ ID NO: 8231 - protein, 12 aa, Artificial Sequence
  Synthetically generated peptide
CELCQNPTCGAC

SEQ ID NO: 8232 - protein, 12 aa, Artificial Sequence
  Synthetically generated peptide
CELCQNGACTGC

SEQ ID NO: 8233 - protein, 12 aa, Artificial Sequence
  Synthetically generated peptide
CELCQNGACTAC

SEQ ID NO: 8234 - protein, 12 aa, Artificial Sequence
  Synthetically generated peptide
CELCQNGACVGC

SEQ ID NO: 8235 - protein, 12 aa, Artificial Sequence
  Synthetically generated peptide
CELCQNGACVAC

SEQ ID NO: 8236 - protein, 12 aa, Artificial Sequence
  Synthetically generated peptide
CELCQNGACGGC

SEQ ID NO: 8237 - protein, 12 aa, Artificial Sequence
  Synthetically generated peptide
CELCQNGACGAC

SEQ ID NO: 8238 - protein, 12 aa, Artificial Sequence
  Synthetically generated peptide
CELCQNGTCTGC

SEQ ID NO: 8239 - protein, 12 aa, Artificial Sequence
  Synthetically generated peptide
CELCQNGTCTAC

SEQ ID NO: 8240 - protein, 12 aa, Artificial Sequence
  Synthetically generated peptide
CELCQNGTCVGC

SEQ ID NO: 8241 - protein, 12 aa, Artificial Sequence
  Synthetically generated peptide
CELCQNGTCVAC

SEQ ID NO: 8242 - protein, 12 aa, Artificial Sequence
  Synthetically generated peptide
CELCQNGTCGGC

SEQ ID NO: 8243 - protein, 12 aa, Artificial Sequence
  Synthetically generated peptide
CELCQNGTCGAC

SEQ ID NO: 8244 - protein, 12 aa, Artificial Sequence
  Synthetically generated peptide
CELCENPACTGC

SEQ ID NO: 8245 - protein, 12 aa, Artificial Sequence
  Synthetically generated peptide
CELCENPACTAC

SEQ ID NO: 8246 - protein, 12 aa, Artificial Sequence
  Synthetically generated peptide
CELCENPACVGC

SEQ ID NO: 8247 - protein, 12 aa, Artificial Sequence
  Synthetically generated peptide
CELCENPACVAC

SEQ ID NO: 8248 - protein, 12 aa, Artificial Sequence
  Synthetically generated peptide
CELCENPACGGC

SEQ ID NO: 8249 - protein, 12 aa, Artificial Sequence
  Synthetically generated peptide
CELCENPACGAC

SEQ ID NO: 8250 - protein, 12 aa, Artificial Sequence
  Synthetically generated peptide
CELCENPTCTGC

SEQ ID NO: 8251 - protein, 12 aa, Artificial Sequence
  Synthetically generated peptide
CELCENPTCTAC

SEQ ID NO: 8252 - protein, 12 aa, Artificial Sequence
  Synthetically generated peptide
CELCENPTCVGC

SEQ ID NO: 8253 - protein, 12 aa, Artificial Sequence
  Synthetically generated peptide
CELCENPTCVAC

SEQ ID NO: 8254 - protein, 12 aa, Artificial Sequence
  Synthetically generated peptide
CELCENPTCGGC

SEQ ID NO: 8255 - protein, 12 aa, Artificial Sequence
  Synthetically generated peptide
CELCENPTCGAC

SEQ ID NO: 8256 - protein, 12 aa, Artificial Sequence
  Synthetically generated peptide
CELCENGACTGC

SEQ ID NO: 8257 - protein, 12 aa, Artificial Sequence
  Synthetically generated peptide
CELCENGACTAC

SEQ ID NO: 8258 - protein, 12 aa, Artificial Sequence
  Synthetically generated peptide
CELCENGACVGC

SEQ ID NO: 8259 - protein, 12 aa, Artificial Sequence
  Synthetically generated peptide
CELCENGACVAC

SEQ ID NO: 8260 - protein, 12 aa, Artificial Sequence
  Synthetically generated peptide
CELCENGACGGC

SEQ ID NO: 8261 - protein, 12 aa, Artificial Sequence
  Synthetically generated peptide
CELCENGACGAC

SEQ ID NO: 8262 - protein, 12 aa, Artificial Sequence
  Synthetically generated peptide
CELCENGTCTGC

SEQ ID NO: 8263 - protein, 12 aa, Artificial Sequence
  Synthetically generated peptide
CELCENGTCTAC

SEQ ID NO: 8264 - protein, 12 aa, Artificial Sequence
  Synthetically generated peptide
CELCENGTCVGC

SEQ ID NO: 8265 - protein, 12 aa, Artificial Sequence
  Synthetically generated peptide
CELCENGTCVAC

SEQ ID NO: 8266 - protein, 12 aa, Artificial Sequence
  Synthetically generated peptide
CELCENGTCGGC

SEQ ID NO: 8267 - protein, 12 aa, Artificial Sequence
  Synthetically generated peptide
CELCENGTCGAC

SEQ ID NO: 8268 - protein, 12 aa, Artificial Sequence
  Synthetically generated peptide
CELCGNPACTGC

SEQ ID NO: 8269 - protein, 12 aa, Artificial Sequence
  Synthetically generated peptide
CELCGNPACTAC

SEQ ID NO: 8270 - protein, 12 aa, Artificial Sequence
  Synthetically generated peptide
CELCGNPACVGC

SEQ ID NO: 8271 - protein, 12 aa, Artificial Sequence
  Synthetically generated peptide
CELCGNPACVAC

SEQ ID NO: 8272 - protein, 12 aa, Artificial Sequence
  Synthetically generated peptide
CELCGNPACGGC

SEQ ID NO: 8273 - protein, 12 aa, Artificial Sequence
  Synthetically generated peptide
CELCGNPACGAC

SEQ ID NO: 8274 - protein, 12 aa, Artificial Sequence
  Synthetically generated peptide
CELCGNPTCTGC

SEQ ID NO: 8275 - protein, 12 aa, Artificial Sequence
  Synthetically generated peptide
CELCGNPTCTAC

SEQ ID NO: 8276 - protein, 12 aa, Artificial Sequence
  Synthetically generated peptide
CELCGNPTCVGC

SEQ ID NO: 8277 - protein, 12 aa, Artificial Sequence
  Synthetically generated peptide
CELCGNPTCVAC

SEQ ID NO: 8278 - protein, 12 aa, Artificial Sequence
  Synthetically generated peptide
CELCGNPTCGGC

SEQ ID NO: 8279 - protein, 12 aa, Artificial Sequence
  Synthetically generated peptide
CELCGNPTCGAC

SEQ ID NO: 8280 - protein, 12 aa, Artificial Sequence
  Synthetically generated peptide
CELCGNGACTGC

SEQ ID NO: 8281 - protein, 12 aa, Artificial Sequence
  Synthetically generated peptide
CELCGNGACTAC

SEQ ID NO: 8282 - protein, 12 aa, Artificial Sequence
  Synthetically generated peptide
CELCGNGACVGC

SEQ ID NO: 8283 - protein, 12 aa, Artificial Sequence
  Synthetically generated peptide
CELCGNGACVAC

SEQ ID NO: 8284 - protein, 12 aa, Artificial Sequence
  Synthetically generated peptide
CELCGNGACGGC

SEQ ID NO: 8285 - protein, 12 aa, Artificial Sequence
  Synthetically generated peptide
CELCGNGACGAC

SEQ ID NO: 8286 - protein, 12 aa, Artificial Sequence
  Synthetically generated peptide
CELCGNGTCTGC

SEQ ID NO: 8287 - protein, 12 aa, Artificial Sequence
  Synthetically generated peptide
CELCGNGTCTAC

SEQ ID NO: 8288 - protein, 12 aa, Artificial Sequence
  Synthetically generated peptide
CELCGNGTCVGC

SEQ ID NO: 8289 - protein, 12 aa, Artificial Sequence
  Synthetically generated peptide
CELCGNGTCVAC

SEQ ID NO: 8290 - protein, 12 aa, Artificial Sequence
  Synthetically generated peptide
CELCGNGTCGGC

SEQ ID NO: 8291 - protein, 12 aa, Artificial Sequence
  Synthetically generated peptide
CELCGNGTCGAC

SEQ ID NO: 8292 - protein, 12 aa, Artificial Sequence
  Synthetically generated peptide
CELCHNPACTGC

SEQ ID NO: 8293 - protein, 12 aa, Artificial Sequence
  Synthetically generated peptide
CELCHNPACTAC

SEQ ID NO: 8294 - protein, 12 aa, Artificial Sequence
  Synthetically generated peptide
CELCHNPACVGC

SEQ ID NO: 8295 - protein, 12 aa, Artificial Sequence
  Synthetically generated peptide
CELCHNPACVAC

SEQ ID NO: 8296 - protein, 12 aa, Artificial Sequence
  Synthetically generated peptide
CELCHNPACGGC

SEQ ID NO: 8297 - protein, 12 aa, Artificial Sequence
  Synthetically generated peptide
CELCHNPACGAC

SEQ ID NO: 8298 - protein, 12 aa, Artificial Sequence
  Synthetically generated peptide
CELCHNPTCTGC

SEQ ID NO: 8299 - protein, 12 aa, Artificial Sequence
  Synthetically generated peptide
CELCHNPTCTAC

SEQ ID NO: 8300 - protein, 12 aa, Artificial Sequence
  Synthetically generated peptide
CELCHNPTCVGC

SEQ ID NO: 8301 - protein, 12 aa, Artificial Sequence
  Synthetically generated peptide
CELCHNPTCVAC

SEQ ID NO: 8302 - protein, 12 aa, Artificial Sequence
  Synthetically generated peptide
CELCHNPTCGGC

SEQ ID NO: 8303 - protein, 12 aa, Artificial Sequence
  Synthetically generated peptide
CELCHNPTCGAC

SEQ ID NO: 8304 - protein, 12 aa, Artificial Sequence
  Synthetically generated peptide
CELCHNGACTGC

SEQ ID NO: 8305 - protein, 12 aa, Artificial Sequence
  Synthetically generated peptide
CELCHNGACTAC

SEQ ID NO: 8306 - protein, 12 aa, Artificial Sequence
  Synthetically generated peptide
CELCHNGACVGC

SEQ ID NO: 8307 - protein, 12 aa, Artificial Sequence
  Synthetically generated peptide
CELCHNGACVAC

SEQ ID NO: 8308 - protein, 12 aa, Artificial Sequence
  Synthetically generated peptide
CELCHNGACGGC

SEQ ID NO: 8309 - protein, 12 aa, Artificial Sequence
  Synthetically generated peptide
CELCHNGACGAC

SEQ ID NO: 8310 - protein, 12 aa, Artificial Sequence
  Synthetically generated peptide
CELCHNGTCTGC

SEQ ID NO: 8311 - protein, 12 aa, Artificial Sequence
  Synthetically generated peptide
CELCHNGTCTAC

SEQ ID NO: 8312 - protein, 12 aa, Artificial Sequence
  Synthetically generated peptide
CELCHNGTCVGC

SEQ ID NO: 8313 - protein, 12 aa, Artificial Sequence
  Synthetically generated peptide
CELCHNGTCVAC

SEQ ID NO: 8314 - protein, 12 aa, Artificial Sequence
  Synthetically generated peptide
CELCHNGTCGGC

SEQ ID NO: 8315 - protein, 12 aa, Artificial Sequence
  Synthetically generated peptide
CELCHNGTCGAC

SEQ ID NO: 8316 - protein, 12 aa, Artificial Sequence
  Synthetically generated peptide
CELCINPACTGC

SEQ ID NO: 8317 - protein, 12 aa, Artificial Sequence
  Synthetically generated peptide
CELCINPACTAC

SEQ ID NO: 8318 - protein, 12 aa, Artificial Sequence
  Synthetically generated peptide
CELCINPACVGC

SEQ ID NO: 8319 - protein, 12 aa, Artificial Sequence
  Synthetically generated peptide
CELCINPACVAC

SEQ ID NO: 8320 - protein, 12 aa, Artificial Sequence
  Synthetically generated peptide
CELCINPACGGC

SEQ ID NO: 8321 - protein, 12 aa, Artificial Sequence
  Synthetically generated peptide
CELCINPACGAC

SEQ ID NO: 8322 - protein, 12 aa, Artificial Sequence
  Synthetically generated peptide
CELCINPTCTGC

SEQ ID NO: 8323 - protein, 12 aa, Artificial Sequence
  Synthetically generated peptide
CELCINPTCTAC

SEQ ID NO: 8324 - protein, 12 aa, Artificial Sequence
  Synthetically generated peptide
CELCINPTCVGC

SEQ ID NO: 8325 - protein, 12 aa, Artificial Sequence
  Synthetically generated peptide
CELCINPTCVAC

SEQ ID NO: 8326 - protein, 12 aa, Artificial Sequence
  Synthetically generated peptide
CELCINPTCGGC

SEQ ID NO: 8327 - protein, 12 aa, Artificial Sequence
  Synthetically generated peptide
CELCINPTCGAC

SEQ ID NO: 8328 - protein, 12 aa, Artificial Sequence
  Synthetically generated peptide
CELCINGACTGC

SEQ ID NO: 8329 - protein, 12 aa, Artificial Sequence
  Synthetically generated peptide
CELCINGACTAC

SEQ ID NO: 8330 - protein, 12 aa, Artificial Sequence
  Synthetically generated peptide
CELCINGACVGC

SEQ ID NO: 8331 - protein, 12 aa, Artificial Sequence
  Synthetically generated peptide
CELCINGACVAC

SEQ ID NO: 8332 - protein, 12 aa, Artificial Sequence
  Synthetically generated peptide
CELCINGACGGC

SEQ ID NO: 8333 - protein, 12 aa, Artificial Sequence
  Synthetically generated peptide
CELCINGACGAC

SEQ ID NO: 8334 - protein, 12 aa, Artificial Sequence
  Synthetically generated peptide
CELCINGTCTGC

SEQ ID NO: 8335 - protein, 12 aa, Artificial Sequence
  Synthetically generated peptide
CELCINGTCTAC

SEQ ID NO: 8336 - protein, 12 aa, Artificial Sequence
  Synthetically generated peptide
CELCINGTCVGC

SEQ ID NO: 8337 - protein, 12 aa, Artificial Sequence
  Synthetically generated peptide
CELCINGTCVAC

SEQ ID NO: 8338 - protein, 12 aa, Artificial Sequence
  Synthetically generated peptide
CELCINGTCGGC

SEQ ID NO: 8339 - protein, 12 aa, Artificial Sequence
  Synthetically generated peptide
CELCINGTCGAC

SEQ ID NO: 8340 - protein, 12 aa, Artificial Sequence
  Synthetically generated peptide
CELCLNPACTGC

SEQ ID NO: 8341 - protein, 12 aa, Artificial Sequence
  Synthetically generated peptide
CELCLNPACTAC

SEQ ID NO: 8342 - protein, 12 aa, Artificial Sequence
  Synthetically generated peptide
CELCLNPACVGC

SEQ ID NO: 8343 - protein, 12 aa, Artificial Sequence
  Synthetically generated peptide
CELCLNPACVAC

SEQ ID NO: 8344 - protein, 12 aa, Artificial Sequence
  Synthetically generated peptide
CELCLNPACGGC

SEQ ID NO: 8345 - protein, 12 aa, Artificial Sequence
  Synthetically generated peptide
CELCLNPACGAC

SEQ ID NO: 8346 - protein, 12 aa, Artificial Sequence
  Synthetically generated peptide
CELCLNPTCTGC

SEQ ID NO: 8347 - protein, 12 aa, Artificial Sequence
  Synthetically generated peptide
CELCLNPTCTAC

SEQ ID NO: 8348 - protein, 12 aa, Artificial Sequence
  Synthetically generated peptide
CELCLNPTCVGC

SEQ ID NO: 8349 - protein, 12 aa, Artificial Sequence
  Synthetically generated peptide
CELCLNPTCVAC

SEQ ID NO: 8350 - protein, 12 aa, Artificial Sequence
  Synthetically generated peptide
CELCLNPTCGGC

SEQ ID NO: 8351 - protein, 12 aa, Artificial Sequence
  Synthetically generated peptide
CELCLNPTCGAC

SEQ ID NO: 8352 - protein, 12 aa, Artificial Sequence
  Synthetically generated peptide
CELCLNGACTGC

SEQ ID NO: 8353 - protein, 12 aa, Artificial Sequence
  Synthetically generated peptide
CELCLNGACTAC

SEQ ID NO: 8354 - protein, 12 aa, Artificial Sequence
  Synthetically generated peptide
CELCLNGACVGC

SEQ ID NO: 8355 - protein, 12 aa, Artificial Sequence
  Synthetically generated peptide
CELCLNGACVAC

SEQ ID NO: 8356 - protein, 12 aa, Artificial Sequence
  Synthetically generated peptide
CELCLNGACGGC

SEQ ID NO: 8357 - protein, 12 aa, Artificial Sequence
  Synthetically generated peptide
CELCLNGACGAC

SEQ ID NO: 8358 - protein, 12 aa, Artificial Sequence
  Synthetically generated peptide
CELCLNGTCTGC

SEQ ID NO: 8359 - protein, 12 aa, Artificial Sequence
  Synthetically generated peptide
CELCLNGTCTAC

SEQ ID NO: 8360 - protein, 12 aa, Artificial Sequence
  Synthetically generated peptide
CELCLNGTCVGC

SEQ ID NO: 8361 - protein, 12 aa, Artificial Sequence
  Synthetically generated peptide
CELCLNGTCVAC

SEQ ID NO: 8362 - protein, 12 aa, Artificial Sequence
  Synthetically generated peptide
CELCLNGTCGGC

SEQ ID NO: 8363 - protein, 12 aa, Artificial Sequence
  Synthetically generated peptide
CELCLNGTCGAC

SEQ ID NO: 8364 - protein, 12 aa, Artificial Sequence
  Synthetically generated peptide
CELCKNPACTGC

SEQ ID NO: 8365 - protein, 12 aa, Artificial Sequence
  Synthetically generated peptide
CELCKNPACTAC

SEQ ID NO: 8366 - protein, 12 aa, Artificial Sequence
  Synthetically generated peptide
CELCKNPACVGC

SEQ ID NO: 8367 - protein, 12 aa, Artificial Sequence
  Synthetically generated peptide
CELCKNPACVAC

SEQ ID NO: 8368 - protein, 12 aa, Artificial Sequence
  Synthetically generated peptide
CELCKNPACGGC

SEQ ID NO: 8369 - protein, 12 aa, Artificial Sequence
  Synthetically generated peptide
CELCKNPACGAC

SEQ ID NO: 8370 - protein, 12 aa, Artificial Sequence
  Synthetically generated peptide
CELCKNPTCTGC

SEQ ID NO: 8371 - protein, 12 aa, Artificial Sequence
  Synthetically generated peptide
CELCKNPTCTAC

SEQ ID NO: 8372 - protein, 12 aa, Artificial Sequence
  Synthetically generated peptide
CELCKNPTCVGC

SEQ ID NO: 8373 - protein, 12 aa, Artificial Sequence
  Synthetically generated peptide
CELCKNPTCVAC

SEQ ID NO: 8374 - protein, 12 aa, Artificial Sequence
  Synthetically generated peptide
CELCKNPTCGGC

SEQ ID NO: 8375 - protein, 12 aa, Artificial Sequence
  Synthetically generated peptide
CELCKNPTCGAC

SEQ ID NO: 8376 - protein, 12 aa, Artificial Sequence
  Synthetically generated peptide
CELCKNGACTGC

SEQ ID NO: 8377 - protein, 12 aa, Artificial Sequence
  Synthetically generated peptide
CELCKNGACTAC

SEQ ID NO: 8378 - protein, 12 aa, Artificial Sequence
  Synthetically generated peptide
CELCKNGACVGC

SEQ ID NO: 8379 - protein, 12 aa, Artificial Sequence
  Synthetically generated peptide
CELCKNGACVAC

SEQ ID NO: 8380 - protein, 12 aa, Artificial Sequence
  Synthetically generated peptide
CELCKNGACGGC

SEQ ID NO: 8381 - protein, 12 aa, Artificial Sequence
  Synthetically generated peptide
CELCKNGACGAC

SEQ ID NO: 8382 - protein, 12 aa, Artificial Sequence
  Synthetically generated peptide
CELCKNGTCTGC

SEQ ID NO: 8383 - protein, 12 aa, Artificial Sequence
  Synthetically generated peptide
CELCKNGTCTAC

SEQ ID NO: 8384 - protein, 12 aa, Artificial Sequence
  Synthetically generated peptide
CELCKNGTCVGC

SEQ ID NO: 8385 - protein, 12 aa, Artificial Sequence
  Synthetically generated peptide
CELCKNGTCVAC

SEQ ID NO: 8386 - protein, 12 aa, Artificial Sequence
  Synthetically generated peptide
CELCKNGTCGGC

SEQ ID NO: 8387 - protein, 12 aa, Artificial Sequence
  Synthetically generated peptide
CELCKNGTCGAC

SEQ ID NO: 8388 - protein, 12 aa, Artificial Sequence
  Synthetically generated peptide
CELCMNPACTGC

SEQ ID NO: 8389 - protein, 12 aa, Artificial Sequence
  Synthetically generated peptide
CELCMNPACTAC

SEQ ID NO: 8390 - protein, 12 aa, Artificial Sequence
  Synthetically generated peptide
CELCMNPACVGC

SEQ ID NO: 8391 - protein, 12 aa, Artificial Sequence
  Synthetically generated peptide
CELCMNPACVAC

SEQ ID NO: 8392 - protein, 12 aa, Artificial Sequence
  Synthetically generated peptide
CELCMNPACGGC

SEQ ID NO: 8393 - protein, 12 aa, Artificial Sequence
  Synthetically generated peptide
CELCMNPACGAC

SEQ ID NO: 8394 - protein, 12 aa, Artificial Sequence
  Synthetically generated peptide
CELCMNPTCTGC

SEQ ID NO: 8395 - protein, 12 aa, Artificial Sequence
  Synthetically generated peptide
CELCMNPTCTAC

SEQ ID NO: 8396 - protein, 12 aa, Artificial Sequence
  Synthetically generated peptide
CELCMNPTCVGC

SEQ ID NO: 8397 - protein, 12 aa, Artificial Sequence
  Synthetically generated peptide
CELCMNPTCVAC

SEQ ID NO: 8398 - protein, 12 aa, Artificial Sequence
  Synthetically generated peptide
CELCMNPTCGGC

SEQ ID NO: 8399 - protein, 12 aa, Artificial Sequence
  Synthetically generated peptide
CELCMNPTCGAC

SEQ ID NO: 8400 - protein, 12 aa, Artificial Sequence
  Synthetically generated peptide
CELCMNGACTGC

SEQ ID NO: 8401 - protein, 12 aa, Artificial Sequence
  Synthetically generated peptide
CELCMNGACTAC

SEQ ID NO: 8402 - protein, 12 aa, Artificial Sequence
  Synthetically generated peptide
CELCMNGACVGC

SEQ ID NO: 8403 - protein, 12 aa, Artificial Sequence
  Synthetically generated peptide
CELCMNGACVAC

SEQ ID NO: 8404 - protein, 12 aa, Artificial Sequence
  Synthetically generated peptide
CELCMNGACGGC

SEQ ID NO: 8405 - protein, 12 aa, Artificial Sequence
  Synthetically generated peptide
CELCMNGACGAC

SEQ ID NO: 8406 - protein, 12 aa, Artificial Sequence
  Synthetically generated peptide
CELCMNGTCTGC

SEQ ID NO: 8407 - protein, 12 aa, Artificial Sequence
  Synthetically generated peptide
CELCMNGTCTAC

SEQ ID NO: 8408 - protein, 12 aa, Artificial Sequence
  Synthetically generated peptide
CELCMNGTCVGC

SEQ ID NO: 8409 - protein, 12 aa, Artificial Sequence
  Synthetically generated peptide
CELCMNGTCVAC

SEQ ID NO: 8410 - protein, 12 aa, Artificial Sequence
  Synthetically generated peptide
CELCMNGTCGGC

SEQ ID NO: 8411 - protein, 12 aa, Artificial Sequence
  Synthetically generated peptide
CELCMNGTCGAC

SEQ ID NO: 8412 - protein, 12 aa, Artificial Sequence
  Synthetically generated peptide
CELCFNPACTGC

SEQ ID NO: 8413 - protein, 12 aa, Artificial Sequence
  Synthetically generated peptide
CELCFNPACTAC

SEQ ID NO: 8414 - protein, 12 aa, Artificial Sequence
  Synthetically generated peptide
CELCFNPACVGC

SEQ ID NO: 8415 - protein, 12 aa, Artificial Sequence
  Synthetically generated peptide
CELCFNPACVAC

SEQ ID NO: 8416 - protein, 12 aa, Artificial Sequence
  Synthetically generated peptide
CELCFNPACGGC

SEQ ID NO: 8417 - protein, 12 aa, Artificial Sequence
  Synthetically generated peptide
CELCFNPACGAC

SEQ ID NO: 8418 - protein, 12 aa, Artificial Sequence
  Synthetically generated peptide
CELCFNPTCTGC

SEQ ID NO: 8419 - protein, 12 aa, Artificial Sequence
  Synthetically generated peptide
CELCFNPTCTAC

SEQ ID NO: 8420 - protein, 12 aa, Artificial Sequence
  Synthetically generated peptide
CELCFNPTCVGC

SEQ ID NO: 8421 - protein, 12 aa, Artificial Sequence
  Synthetically generated peptide
CELCFNPTCVAC

SEQ ID NO: 8422 - protein, 12 aa, Artificial Sequence
  Synthetically generated peptide
CELCFNPTCGGC

SEQ ID NO: 8423 - protein, 12 aa, Artificial Sequence
  Synthetically generated peptide
CELCFNPTCGAC

SEQ ID NO: 8424 - protein, 12 aa, Artificial Sequence
  Synthetically generated peptide
CELCFNGACTGC

SEQ ID NO: 8425 - protein, 12 aa, Artificial Sequence
  Synthetically generated peptide
CELCFNGACTAC

SEQ ID NO: 8426 - protein, 12 aa, Artificial Sequence
  Synthetically generated peptide
CELCFNGACVGC

SEQ ID NO: 8427 - protein, 12 aa, Artificial Sequence
  Synthetically generated peptide
CELCFNGACVAC

SEQ ID NO: 8428 - protein, 12 aa, Artificial Sequence
  Synthetically generated peptide
CELCFNGACGGC

SEQ ID NO: 8429 - protein, 12 aa, Artificial Sequence
  Synthetically generated peptide
CELCFNGACGAC

SEQ ID NO: 8430 - protein, 12 aa, Artificial Sequence
  Synthetically generated peptide
CELCFNGTCTGC

SEQ ID NO: 8431 - protein, 12 aa, Artificial Sequence
  Synthetically generated peptide
CELCFNGTCTAC

SEQ ID NO: 8432 - protein, 12 aa, Artificial Sequence
  Synthetically generated peptide
CELCFNGTCVGC

SEQ ID NO: 8433 - protein, 12 aa, Artificial Sequence
  Synthetically generated peptide
CELCFNGTCVAC

SEQ ID NO: 8434 - protein, 12 aa, Artificial Sequence
  Synthetically generated peptide
CELCFNGTCGGC

SEQ ID NO: 8435 - protein, 12 aa, Artificial Sequence
  Synthetically generated peptide
CELCFNGTCGAC

SEQ ID NO: 8436 - protein, 12 aa, Artificial Sequence
  Synthetically generated peptide
CELCPNPACTGC

SEQ ID NO: 8437 - protein, 12 aa, Artificial Sequence
  Synthetically generated peptide
CELCPNPACTAC

SEQ ID NO: 8438 - protein, 12 aa, Artificial Sequence
  Synthetically generated peptide
CELCPNPACVGC

SEQ ID NO: 8439 - protein, 12 aa, Artificial Sequence
  Synthetically generated peptide
CELCPNPACVAC

SEQ ID NO: 8440 - protein, 12 aa, Artificial Sequence
  Synthetically generated peptide
CELCPNPACGGC

SEQ ID NO: 8441 - protein, 12 aa, Artificial Sequence
  Synthetically generated peptide
CELCPNPACGAC

SEQ ID NO: 8442 - protein, 12 aa, Artificial Sequence
  Synthetically generated peptide
CELCPNPTCTGC

SEQ ID NO: 8443 - protein, 12 aa, Artificial Sequence
  Synthetically generated peptide
CELCPNPTCTAC

SEQ ID NO: 8444 - protein, 12 aa, Artificial Sequence
  Synthetically generated peptide
CELCPNPTCVGC

SEQ ID NO: 8445 - protein, 12 aa, Artificial Sequence
  Synthetically generated peptide
CELCPNPTCVAC

SEQ ID NO: 8446 - protein, 12 aa, Artificial Sequence
  Synthetically generated peptide
CELCPNPTCGGC

SEQ ID NO: 8447 - protein, 12 aa, Artificial Sequence
  Synthetically generated peptide
CELCPNPTCGAC

SEQ ID NO: 8448 - protein, 12 aa, Artificial Sequence
  Synthetically generated peptide
CELCPNGACTGC

SEQ ID NO: 8449 - protein, 12 aa, Artificial Sequence
  Synthetically generated peptide
CELCPNGACTAC

SEQ ID NO: 8450 - protein, 12 aa, Artificial Sequence
  Synthetically generated peptide
CELCPNGACVGC

SEQ ID NO: 8451 - protein, 12 aa, Artificial Sequence
  Synthetically generated peptide
CELCPNGACVAC

SEQ ID NO: 8452 - protein, 12 aa, Artificial Sequence
  Synthetically generated peptide
CELCPNGACGGC

SEQ ID NO: 8453 - protein, 12 aa, Artificial Sequence
  Synthetically generated peptide
CELCPNGACGAC

SEQ ID NO: 8454 - protein, 12 aa, Artificial Sequence
  Synthetically generated peptide
CELCPNGTCTGC

SEQ ID NO: 8455 - protein, 12 aa, Artificial Sequence
  Synthetically generated peptide
CELCPNGTCTAC

SEQ ID NO: 8456 - protein, 12 aa, Artificial Sequence
  Synthetically generated peptide
CELCPNGTCVGC

SEQ ID NO: 8457 - protein, 12 aa, Artificial Sequence
  Synthetically generated peptide
CELCPNGTCVAC

SEQ ID NO: 8458 - protein, 12 aa, Artificial Sequence
  Synthetically generated peptide
CELCPNGTCGGC

SEQ ID NO: 8459 - protein, 12 aa, Artificial Sequence
  Synthetically generated peptide
CELCPNGTCGAC

SEQ ID NO: 8460 - protein, 12 aa, Artificial Sequence
  Synthetically generated peptide
CELCSNPACTGC

SEQ ID NO: 8461 - protein, 12 aa, Artificial Sequence
  Synthetically generated peptide
CELCSNPACTAC

SEQ ID NO: 8462 - protein, 12 aa, Artificial Sequence
  Synthetically generated peptide
CELCSNPACVGC

SEQ ID NO: 8463 - protein, 12 aa, Artificial Sequence
  Synthetically generated peptide
CELCSNPACVAC

SEQ ID NO: 8464 - protein, 12 aa, Artificial Sequence
  Synthetically generated peptide
CELCSNPACGGC

SEQ ID NO: 8465 - protein, 12 aa, Artificial Sequence
  Synthetically generated peptide
CELCSNPACGAC

SEQ ID NO: 8466 - protein, 12 aa, Artificial Sequence
  Synthetically generated peptide
CELCSNPTCTGC

SEQ ID NO: 8467 - protein, 12 aa, Artificial Sequence
  Synthetically generated peptide
CELCSNPTCTAC

SEQ ID NO: 8468 - protein, 12 aa, Artificial Sequence
  Synthetically generated peptide
CELCSNPTCVGC

SEQ ID NO: 8469 - protein, 12 aa, Artificial Sequence
  Synthetically generated peptide
CELCSNPTCVAC

SEQ ID NO: 8470 - protein, 12 aa, Artificial Sequence
  Synthetically generated peptide
CELCSNPTCGGC

SEQ ID NO: 8471 - protein, 12 aa, Artificial Sequence
  Synthetically generated peptide
CELCSNPTCGAC

SEQ ID NO: 8472 - protein, 12 aa, Artificial Sequence
  Synthetically generated peptide
CELCSNGACTGC

SEQ ID NO: 8473 - protein, 12 aa, Artificial Sequence
  Synthetically generated peptide
CELCSNGACTAC

SEQ ID NO: 8474 - protein, 12 aa, Artificial Sequence
  Synthetically generated peptide
CELCSNGACVGC

SEQ ID NO: 8475 - protein, 12 aa, Artificial Sequence
  Synthetically generated peptide
CELCSNGACVAC

SEQ ID NO: 8476 - protein, 12 aa, Artificial Sequence
  Synthetically generated peptide
CELCSNGACGGC

SEQ ID NO: 8477 - protein, 12 aa, Artificial Sequence
  Synthetically generated peptide
CELCSNGACGAC

SEQ ID NO: 8478 - protein, 12 aa, Artificial Sequence
  Synthetically generated peptide
CELCSNGTCTGC

SEQ ID NO: 8479 - protein, 12 aa, Artificial Sequence
  Synthetically generated peptide
CELCSNGTCTAC

SEQ ID NO: 8480 - protein, 12 aa, Artificial Sequence
  Synthetically generated peptide
CELCSNGTCVGC

SEQ ID NO: 8481 - protein, 12 aa, Artificial Sequence
  Synthetically generated peptide
CELCSNGTCVAC

SEQ ID NO: 8482 - protein, 12 aa, Artificial Sequence
  Synthetically generated peptide
CELCSNGTCGGC

SEQ ID NO: 8483 - protein, 12 aa, Artificial Sequence
  Synthetically generated peptide
CELCSNGTCGAC

SEQ ID NO: 8484 - protein, 12 aa, Artificial Sequence
  Synthetically generated peptide
CELCTNPACTGC

SEQ ID NO: 8485 - protein, 12 aa, Artificial Sequence
  Synthetically generated peptide
CELCTNPACTAC

SEQ ID NO: 8486 - protein, 12 aa, Artificial Sequence
  Synthetically generated peptide
CELCTNPACVGC

SEQ ID NO: 8487 - protein, 12 aa, Artificial Sequence
  Synthetically generated peptide
CELCTNPACVAC

SEQ ID NO: 8488 - protein, 12 aa, Artificial Sequence
  Synthetically generated peptide
CELCTNPACGGC

SEQ ID NO: 8489 - protein, 12 aa, Artificial Sequence
  Synthetically generated peptide
CELCTNPACGAC

SEQ ID NO: 8490 - protein, 12 aa, Artificial Sequence
  Synthetically generated peptide
CELCTNPTCTGC

SEQ ID NO: 8491 - protein, 12 aa, Artificial Sequence
  Synthetically generated peptide
CELCTNPTCTAC

SEQ ID NO: 8492 - protein, 12 aa, Artificial Sequence
  Synthetically generated peptide
CELCTNPTCVGC

SEQ ID NO: 8493 - protein, 12 aa, Artificial Sequence
  Synthetically generated peptide
CELCTNPTCVAC

SEQ ID NO: 8494 - protein, 12 aa, Artificial Sequence
  Synthetically generated peptide
CELCTNPTCGGC

SEQ ID NO: 8495 - protein, 12 aa, Artificial Sequence
  Synthetically generated peptide
CELCTNPTCGAC

SEQ ID NO: 8496 - protein, 12 aa, Artificial Sequence
  Synthetically generated peptide
CELCTNGACTGC

SEQ ID NO: 8497 - protein, 12 aa, Artificial Sequence
  Synthetically generated peptide
CELCTNGACTAC

SEQ ID NO: 8498 - protein, 12 aa, Artificial Sequence
  Synthetically generated peptide
CELCTNGACVGC

SEQ ID NO: 8499 - protein, 12 aa, Artificial Sequence
  Synthetically generated peptide
CELCTNGACVAC

SEQ ID NO: 8500 - protein, 12 aa, Artificial Sequence
  Synthetically generated peptide
CELCTNGACGGC

SEQ ID NO: 8501 - protein, 12 aa, Artificial Sequence
  Synthetically generated peptide
CELCTNGACGAC

SEQ ID NO: 8502 - protein, 12 aa, Artificial Sequence
  Synthetically generated peptide
CELCTNGTCTGC

SEQ ID NO: 8503 - protein, 12 aa, Artificial Sequence
  Synthetically generated peptide
CELCTNGTCTAC

SEQ ID NO: 8504 - protein, 12 aa, Artificial Sequence
  Synthetically generated peptide
CELCTNGTCVGC

SEQ ID NO: 8505 - protein, 12 aa, Artificial Sequence
  Synthetically generated peptide
CELCTNGTCVAC

SEQ ID NO: 8506 - protein, 12 aa, Artificial Sequence
  Synthetically generated peptide
CELCTNGTCGGC

SEQ ID NO: 8507 - protein, 12 aa, Artificial Sequence
  Synthetically generated peptide
CELCTNGTCGAC

SEQ ID NO: 8508 - protein, 12 aa, Artificial Sequence
  Synthetically generated peptide
CELCWNPACTGC

SEQ ID NO: 8509 - protein, 12 aa, Artificial Sequence
  Synthetically generated peptide
CELCWNPACTAC

SEQ ID NO: 8510 - protein, 12 aa, Artificial Sequence
  Synthetically generated peptide
CELCWNPACVGC

SEQ ID NO: 8511 - protein, 12 aa, Artificial Sequence
  Synthetically generated peptide
CELCWNPACVAC

SEQ ID NO: 8512 - protein, 12 aa, Artificial Sequence
  Synthetically generated peptide
CELCWNPACGGC

SEQ ID NO: 8513 - protein, 12 aa, Artificial Sequence
  Synthetically generated peptide
CELCWNPACGAC

SEQ ID NO: 8514 - protein, 12 aa, Artificial Sequence
  Synthetically generated peptide
CELCWNPTCTGC

SEQ ID NO: 8515 - protein, 12 aa, Artificial Sequence
  Synthetically generated peptide
CELCWNPTCTAC

SEQ ID NO: 8516 - protein, 12 aa, Artificial Sequence
  Synthetically generated peptide
CELCWNPTCVGC

SEQ ID NO: 8517 - protein, 12 aa, Artificial Sequence
  Synthetically generated peptide
CELCWNPTCVAC

SEQ ID NO: 8518 - protein, 12 aa, Artificial Sequence
  Synthetically generated peptide
CELCWNPTCGGC

SEQ ID NO: 8519 - protein, 12 aa, Artificial Sequence
  Synthetically generated peptide
CELCWNPTCGAC

SEQ ID NO: 8520 - protein, 12 aa, Artificial Sequence
  Synthetically generated peptide
CELCWNGACTGC

SEQ ID NO: 8521 - protein, 12 aa, Artificial Sequence
  Synthetically generated peptide
CELCWNGACTAC

SEQ ID NO: 8522 - protein, 12 aa, Artificial Sequence
  Synthetically generated peptide
CELCWNGACVGC

SEQ ID NO: 8523 - protein, 12 aa, Artificial Sequence
  Synthetically generated peptide
CELCWNGACVAC

SEQ ID NO: 8524 - protein, 12 aa, Artificial Sequence
  Synthetically generated peptide
CELCWNGACGGC

SEQ ID NO: 8525 - protein, 12 aa, Artificial Sequence
  Synthetically generated peptide
CELCWNGACGAC

SEQ ID NO: 8526 - protein, 12 aa, Artificial Sequence
  Synthetically generated peptide
CELCWNGTCTGC

SEQ ID NO: 8527 - protein, 12 aa, Artificial Sequence
  Synthetically generated peptide
CELCWNGTCTAC

SEQ ID NO: 8528 - protein, 12 aa, Artificial Sequence
  Synthetically generated peptide
CELCWNGTCVGC

SEQ ID NO: 8529 - protein, 12 aa, Artificial Sequence
  Synthetically generated peptide
CELCWNGTCVAC

SEQ ID NO: 8530 - protein, 12 aa, Artificial Sequence
  Synthetically generated peptide
CELCWNGTCGGC

SEQ ID NO: 8531 - protein, 12 aa, Artificial Sequence
  Synthetically generated peptide
CELCWNGTCGAC

SEQ ID NO: 8532 - protein, 12 aa, Artificial Sequence
  Synthetically generated peptide
CELCYNPACTGC

SEQ ID NO: 8533 - protein, 12 aa, Artificial Sequence
  Synthetically generated peptide
CELCYNPACTAC

SEQ ID NO: 8534 - protein, 12 aa, Artificial Sequence
  Synthetically generated peptide
CELCYNPACVGC

SEQ ID NO: 8535 - protein, 12 aa, Artificial Sequence
  Synthetically generated peptide
CELCYNPACVAC

SEQ ID NO: 8536 - protein, 12 aa, Artificial Sequence
  Synthetically generated peptide
CELCYNPACGGC

SEQ ID NO: 8537 - protein, 12 aa, Artificial Sequence
  Synthetically generated peptide
CELCYNPACGAC

SEQ ID NO: 8538 - protein, 12 aa, Artificial Sequence
  Synthetically generated peptide
CELCYNPTCTGC

SEQ ID NO: 8539 - protein, 12 aa, Artificial Sequence
  Synthetically generated peptide
CELCYNPTCTAC

SEQ ID NO: 8540 - protein, 12 aa, Artificial Sequence
  Synthetically generated peptide
CELCYNPTCVGC

SEQ ID NO: 8541 - protein, 12 aa, Artificial Sequence
  Synthetically generated peptide
CELCYNPTCVAC

SEQ ID NO: 8542 - protein, 12 aa, Artificial Sequence
  Synthetically generated peptide
CELCYNPTCGGC

SEQ ID NO: 8543 - protein, 12 aa, Artificial Sequence
  Synthetically generated peptide
CELCYNPTCGAC

SEQ ID NO: 8544 - protein, 12 aa, Artificial Sequence
  Synthetically generated peptide
CELCYNGACTGC

SEQ ID NO: 8545 - protein, 12 aa, Artificial Sequence
  Synthetically generated peptide
CELCYNGACTAC

SEQ ID NO: 8546 - protein, 12 aa, Artificial Sequence
  Synthetically generated peptide
CELCYNGACVGC

SEQ ID NO: 8547 - protein, 12 aa, Artificial Sequence
  Synthetically generated peptide
CELCYNGACVAC

SEQ ID NO: 8548 - protein, 12 aa, Artificial Sequence
  Synthetically generated peptide
CELCYNGACGGC

SEQ ID NO: 8549 - protein, 12 aa, Artificial Sequence
  Synthetically generated peptide
CELCYNGACGAC

SEQ ID NO: 8550 - protein, 12 aa, Artificial Sequence
  Synthetically generated peptide
CELCYNGTCTGC

SEQ ID NO: 8551 - protein, 12 aa, Artificial Sequence
  Synthetically generated peptide
CELCYNGTCTAC

SEQ ID NO: 8552 - protein, 12 aa, Artificial Sequence
  Synthetically generated peptide
CELCYNGTCVGC

SEQ ID NO: 8553 - protein, 12 aa, Artificial Sequence
  Synthetically generated peptide
CELCYNGTCVAC

SEQ ID NO: 8554 - protein, 12 aa, Artificial Sequence
  Synthetically generated peptide
CELCYNGTCGGC

SEQ ID NO: 8555 - protein, 12 aa, Artificial Sequence
  Synthetically generated peptide
CELCYNGTCGAC

SEQ ID NO: 8556 - protein, 12 aa, Artificial Sequence
  Synthetically generated peptide
CELCVNPACTGC

SEQ ID NO: 8557 - protein, 12 aa, Artificial Sequence
  Synthetically generated peptide
CELCVNPACTAC

SEQ ID NO: 8558 - protein, 12 aa, Artificial Sequence
  Synthetically generated peptide
CELCVNPACVGC

SEQ ID NO: 8559 - protein, 12 aa, Artificial Sequence
  Synthetically generated peptide
CELCVNPACVAC

SEQ ID NO: 8560 - protein, 12 aa, Artificial Sequence
  Synthetically generated peptide
CELCVNPACGGC

SEQ ID NO: 8561 - protein, 12 aa, Artificial Sequence
  Synthetically generated peptide
CELCVNPACGAC

SEQ ID NO: 8562 - protein, 12 aa, Artificial Sequence
  Synthetically generated peptide
CELCVNPTCTGC

SEQ ID NO: 8563 - protein, 12 aa, Artificial Sequence
  Synthetically generated peptide
CELCVNPTCTAC

SEQ ID NO: 8564 - protein, 12 aa, Artificial Sequence
  Synthetically generated peptide
CELCVNPTCVGC

SEQ ID NO: 8565 - protein, 12 aa, Artificial Sequence
  Synthetically generated peptide
CELCVNPTCVAC

SEQ ID NO: 8566 - protein, 12 aa, Artificial Sequence
  Synthetically generated peptide
CELCVNPTCGGC

SEQ ID NO: 8567 - protein, 12 aa, Artificial Sequence
  Synthetically generated peptide
CELCVNPTCGAC

SEQ ID NO: 8568 - protein, 12 aa, Artificial Sequence
  Synthetically generated peptide
CELCVNGACTGC

SEQ ID NO: 8569 - protein, 12 aa, Artificial Sequence
  Synthetically generated peptide
CELCVNGACTAC

SEQ ID NO: 8570 - protein, 12 aa, Artificial Sequence
  Synthetically generated peptide
CELCVNGACVGC

SEQ ID NO: 8571 - protein, 12 aa, Artificial Sequence
  Synthetically generated peptide
CELCVNGACVAC

SEQ ID NO: 8572 - protein, 12 aa, Artificial Sequence
  Synthetically generated peptide
CELCVNGACGGC

SEQ ID NO: 8573 - protein, 12 aa, Artificial Sequence
  Synthetically generated peptide
CELCVNGACGAC

SEQ ID NO: 8574 - protein, 12 aa, Artificial Sequence
  Synthetically generated peptide
CELCVNGTCTGC

SEQ ID NO: 8575 - protein, 12 aa, Artificial Sequence
  Synthetically generated peptide
CELCVNGTCTAC

SEQ ID NO: 8576 - protein, 12 aa, Artificial Sequence
  Synthetically generated peptide
CELCVNGTCVGC

SEQ ID NO: 8577 - protein, 12 aa, Artificial Sequence
  Synthetically generated peptide
CELCVNGTCVAC

SEQ ID NO: 8578 - protein, 12 aa, Artificial Sequence
  Synthetically generated peptide
CELCVNGTCGGC

SEQ ID NO: 8579 - protein, 12 aa, Artificial Sequence
  Synthetically generated peptide
CELCVNGTCGAC

SEQ ID NO: 8580 - protein, 11 aa, Artificial Sequence
  Synthetically generated peptide
CELCNPACTGC

SEQ ID NO: 8581 - protein, 11 aa, Artificial Sequence
  Synthetically generated peptide
CELCNPACTAC

SEQ ID NO: 8582 - protein, 11 aa, Artificial Sequence
  Synthetically generated peptide
CELCNPACVGC

SEQ ID NO: 8583 - protein, 11 aa, Artificial Sequence
  Synthetically generated peptide
CELCNPACVAC

SEQ ID NO: 8584 - protein, 11 aa, Artificial Sequence
  Synthetically generated peptide
CELCNPACGGC

SEQ ID NO: 8585 - protein, 11 aa, Artificial Sequence
  Synthetically generated peptide
CELCNPACGAC

SEQ ID NO: 8586 - protein, 11 aa, Artificial Sequence
  Synthetically generated peptide
CELCNPTCTGC

SEQ ID NO: 8587 - protein, 11 aa, Artificial Sequence
  Synthetically generated peptide
CELCNPTCTAC

SEQ ID NO: 8588 - protein, 11 aa, Artificial Sequence
  Synthetically generated peptide
CELCNPTCVGC

SEQ ID NO: 8589 - protein, 11 aa, Artificial Sequence
  Synthetically generated peptide
CELCNPTCVAC

SEQ ID NO: 8590 - protein, 11 aa, Artificial Sequence
  Synthetically generated peptide
CELCNPTCGGC

SEQ ID NO: 8591 - protein, 11 aa, Artificial Sequence
  Synthetically generated peptide
CELCNPTCGAC

SEQ ID NO: 8592 - protein, 11 aa, Artificial Sequence
  Synthetically generated peptide
CELCNGACTGC

SEQ ID NO: 8593 - protein, 11 aa, Artificial Sequence
  Synthetically generated peptide
CELCNGACTAC

SEQ ID NO: 8594 - protein, 11 aa, Artificial Sequence
  Synthetically generated peptide
CELCNGACVGC

SEQ ID NO: 8595 - protein, 11 aa, Artificial Sequence
  Synthetically generated peptide
CELCNGACVAC

SEQ ID NO: 8596 - protein, 11 aa, Artificial Sequence
  Synthetically generated peptide
CELCNGACGGC

SEQ ID NO: 8597 - protein, 11 aa, Artificial Sequence
  Synthetically generated peptide
CELCNGACGAC

SEQ ID NO: 8598 - protein, 11 aa, Artificial Sequence
  Synthetically generated peptide
CELCNGTCTGC

SEQ ID NO: 8599 - protein, 11 aa, Artificial Sequence
  Synthetically generated peptide
CELCNGTCTAC

SEQ ID NO: 8600 - protein, 11 aa, Artificial Sequence
  Synthetically generated peptide
CELCNGTCVGC

SEQ ID NO: 8601 - protein, 11 aa, Artificial Sequence
  Synthetically generated peptide
CELCNGTCVAC

SEQ ID NO: 8602 - protein, 11 aa, Artificial Sequence
  Synthetically generated peptide
CELCNGTCGGC

SEQ ID NO: 8603 - protein, 11 aa, Artificial Sequence
  Synthetically generated peptide
CELCNGTCGAC

SEQ ID NO: 8604 - protein, 7 aa, Artificial Sequence
  Synthetically generated peptide
IAEDSHT

SEQ ID NO: 8605 - protein, 7 aa, Artificial Sequence
  Synthetically generated peptide
IAQDPST

SEQ ID NO: 8606 - protein, 4 aa, Artificial Sequence
  Synthetically generated peptide
DPNT

SEQ ID NO: 8607 - protein, 7 aa, Artificial Sequence
  Synthetically generated peptide
IAQDPNT

SEQ ID NO: 8608 - protein, 4 aa, Artificial Sequence
  Synthetically generated peptide
KPNT

SEQ ID NO: 8609 - protein, 4 aa, Artificial Sequence
  Synthetically generated peptide
DPGT

SEQ ID NO: 8610 - protein, 5 aa, Artificial Sequence
  Synthetically generated peptide
EDPGT

SEQ ID NO: 8611 - protein, 7 aa, Artificial Sequence
  Synthetically generated peptide
VAARADL

SEQ ID NO: 8612 - protein, 7 aa, Artificial Sequence
  Synthetically generated peptide
RTIANDD

SEQ ID NO: 8613 - protein, 6 aa, Artificial Sequence
  Synthetically generated peptide
TIANDD

SEQ ID NO: 8614 - protein, 7 aa, Artificial Sequence
  Synthetically generated peptide
RTMDNDE

SEQ ID NO: 8615 - protein, 7 aa, Artificial Sequence
  Synthetically generated peptide
RTIAGDD

SEQ ID NO: 8616 - protein, 6 aa, Artificial Sequence
  Synthetically generated peptide
RTIAND

SEQ ID NO: 8617 - protein, 7 aa, Artificial Sequence
  Synthetically generated peptide
RSISQED

SEQ ID NO: 8618 - protein, 7 aa, Artificial Sequence
  Synthetically generated peptide
RTIATDE

SEQ ID NO: 8619 - protein, 7 aa, Artificial Sequence
  Synthetically generated peptide
IITPPDP

SEQ ID NO: 8620 - protein, 7 aa, Artificial Sequence
  Synthetically generated peptide
RYINQEE

SEQ ID NO: 8621 - protein, 6 aa, Artificial Sequence
  Synthetically generated peptide
ASSYAS

SEQ ID NO: 8622 - protein, 6 aa, Artificial Sequence
  Synthetically generated peptide
TSSYAS

SEQ ID NO: 8623 - protein, 34 aa, Artificial Sequence
  Synthetically generated peptide
IKPEAPGEDASPEELNRYYASLRHYLNLVTRQRY

SEQ ID NO: 8624 - protein, 100 aa, Artificial Sequence
  Synthetically generated peptide
MNAFLLSALCLLGAWAALAGGVTVQDGNFSFSLESVKKLKDLQEPQEPRVGKLRNFAPIPGEPVVPILCSNPNFPEELKPLCKEPNAQEILQRLEEIAED

SEQ ID NO: 8625 - protein, 96 aa, Artificial Sequence
  Synthetically generated peptide
MGCRAASGLLPGVAVVLLLLLQSTQSVYIQYQGFRVQLESMKKLSDLEAQWAPSPRLQAQSLLPAVCHHPALPQDLQPVCASQEASSIFKTLRTIA

SEQ ID NO: 8626 - protein, 16 aa, Domestic cow
NDDCELCVNVACTGCS

SEQ ID NO: 8627 - protein, 15 aa, Xenopus laevis
PDVCDVCAFAACSGC

SEQ ID NO: 8628 - protein, 15 aa, Takifugu
LDLCEICAFAACTGC

SEQ ID NO: 8629 - protein, 15 aa, Danio rerio
VDVCEICAFAACTGC

SEQ ID NO: 8630 - protein, 15 aa, Danio rerio
LDICEICAFAACTGC

SEQ ID NO: 8631 - protein, 16 aa, Gallus gallus
ADLCEICANAACSGCF

SEQ ID NO: 8632 - protein, 17 aa, Takifugu
LDPCEICANPSCFGCLN

SEQ ID NO: 8633 - protein, 15 aa, Anguilla
IDPCEICANVACTGC

SEQ ID NO: 8634 - protein, 17 aa, Fundulus heteroclitus
SDPCEICANPSCFGCLD

What is claimed is:

1. A method for treating a disorder selected from the groups consisting of congestive heart failure, hypertension, salt dependent high blood pressure, hepatic edema and liver cirrhosis, the method comprising administering to a subject in need thereof a composition comprising a polypeptide comprising the amino acid sequence: $Xaa_1$ $Xaa_2$ $Xaa_3$ $Cys_4$ $Xaa_5$ $Xaa_6$ $Xaa_7$ $Xaa_8$ $Xaa_9$ $Xaa_{10}$ $Xaa_{11}$ $Cys_{12}$ $Xaa_{13}$ $Xaa_{14}$ $Xaa_{15}$ $Xaa_{16}$ (SEQ ID NO:1) or a pharmaceutically acceptable salt thereof, wherein:

$Xaa_1$ is Ser, Asn, Tyr, Ala, Gln, Pro, Lys, Gly, or Thr, or is missing;
$Xaa_2$ is His, Asp, Glu, Ala, Ser, Asn, Gly, or is missing;
$Xaa_3$ is Thr, Asp, Ser, Glu, Pro, Val or Leu;
$Xaa_5$ is Asp, Ile or Glu;
$Xaa_6$ is Ile, Trp or Leu;
$Xaa_7$ is Cys, Ser, or Tyr;
$Xaa_8$ is Ala, Val, Thr, Ile, Met or is missing;
$Xaa_9$ is Phe, Tyr, Asn or Trp;
$Xaa_{10}$ is Ala, Val, Met, Thr or Ile;
$Xaa_{11}$ is Ala or Val;

Xaa$_{13}$ is Ala or Thr;
Xaa$_{14}$ is Gly, Ala or Ser;
Xaa$_{15}$ is Cys, Tyr or is missing; and
Xaa$_{16}$ is His, Leu or Ser.

2. The method of claim 1 wherein the polypeptide comprises the amino acid sequence Asn Asp Asp Cys Glu Leu Cys Val Asn Val Ala Cys Thr Gly Cys Leu (SEQ ID NO:44) or a pharmaceutically acceptable salt thereof.

3. The method of claim 1 wherein the composition comprises a pharmaceutically acceptable carrier and the polypeptide comprising SEQ ID NO:1 or a pharmaceutically acceptable salt thereof.

4. The method of claim 1 wherein the disorder is congestive heart failure.

5. A method for treating congestive heart failure comprising administering to a subject in need thereof a composition comprising a polypeptide comprising the amino acid sequence Asn Asp Asp Cys Glu Leu Cys Val Asn Val Ala Cys Thr Gly Cys Leu (SEQ ID NO:44) or a pharmaceutically acceptable salt thereof.

6. The method of claim 1 wherein the polypeptide consists of the aminio acid sequence of SEQ ID NO: 1 or a pharmaceutically acceptable acceptable salt thereof.

7. The method of claim 2 wherein the polypeptide consists of the amino acid sequence Asn Asp Asp Cys Glu Leu Cys Val Asn Val Ala Cys Thr Gly Cys Leu (SEQ ID NO:44) or a pharmaceutically acceptable salt thereof.

8. The method of claim 3 wherein the composition comprises a pharmaceutically acceptable carrier and a polypeptide consisting of the amino acid sequence of SEQ ID NO:1 or a pharmaceutically acceptable salt thereof.

9. The method of claim 6 wherein the disorder is congestive heart failure.

10. The method of claim 5 wherein the polypeptide consists of the amino acid sequence Asn Asp Asp Cys Glu Leu Cys Val Asn Val Ala Cys Thr Gly Cys Leu (SEQ ID NO:44) or a pharmaceutically acceptable salt thereof.

11. The method of claim 1 wherein the polypeptide comprises the amino acid sequence Asn Asp Glu Cys Glu Leu Cys Val Asn Val Ala Cys Thr Gly Cys Leu (SEQ ID NO:73) or a pharmaceutically acceptable salt thereof.

12. The method of claim 11 wherein the polypeptide consists of the amino acid sequence Asn Asp Glu Cys Glu Leu Cys Val Asn Val Ala Cys Thr Gly Cys Leu (SEQ ID NO:73) or a pharmaceutically acceptable salt thereof.

13. A method for treating congestive heart failure comprising administering to a subject in need thereof a composition comprising a polypeptide comprising the amino acid sequence Asn Asp Glu Cys Glu Leu Cys Val Asn Val Ala Cys Thr Gly Cys Leu (SEQ ID NO:73) or a pharmaceutically acceptable salt thereof.

14. The method of claim 13 wherein the polypeptide consists of the amino acid sequence Asn Asp Glu Cys Glu Leu Cys Val Asn Val Ala Cys Thr Gly Cys Leu (SEQ ID NO:73) or a pharmaceutically acceptable salt thereof.

* * * * *